United States Patent 12,590,386 (RECOMBINANT POLYCLONAL PROTEINS AND METHODS OF USE THEREOF) - sequence listing, part 5

SEQ ID NO: 114512 - protein, 22 aa, Homo sapiens
  heavy chain complementarity determining region 3 for antibody 57256
AREAPLLRLGELSYGGYYGMDV

SEQ ID NO: 114513 - protein, 9 aa, Homo sapiens
  light chain complementarity determining region 3 for antibody 57257
LQDYNYPWT

SEQ ID NO: 114514 - protein, 22 aa, Homo sapiens
  heavy chain complementarity determining region 3 for antibody 57257
ARDVRDYDILTGSYNGANYFDY

SEQ ID NO: 114515 - protein, 9 aa, Homo sapiens
  light chain complementarity determining region 3 for antibody 57258
QQYGSSPYT

SEQ ID NO: 114516 - protein, 20 aa, Homo sapiens
  heavy chain complementarity determining region 3 for antibody 57258
AREQVLWFGNLHYFYYGMDV

SEQ ID NO: 114517 - protein, 9 aa, Homo sapiens
  light chain complementarity determining region 3 for antibody 57259
QQLNTYPYT

SEQ ID NO: 114518 - protein, 11 aa, Homo sapiens
  heavy chain complementarity determining region 3 for antibody 57259
ARIGGNYSFDY

SEQ ID NO: 114519 - protein, 9 aa, Homo sapiens
  light chain complementarity determining region 3 for antibody 57260
QQLNSYPFT

SEQ ID NO: 114520 - protein, 21 aa, Homo sapiens
  heavy chain complementarity determining region 3 for antibody 57260
ARGEDYYGSGTPSYYYYGMDV

SEQ ID NO: 114521 - protein, 9 aa, Homo sapiens
  light chain complementarity determining region 3 for antibody 57261
QQFNNYPYT

SEQ ID NO: 114522 - protein, 11 aa, Homo sapiens
  heavy chain complementarity determining region 3 for antibody 57261
ARDPRISGFDY

SEQ ID NO: 114523 - protein, 9 aa, Homo sapiens
  light chain complementarity determining region 3 for antibody 57262
QQFNNYPLT

SEQ ID NO: 114524 - protein, 15 aa, Homo sapiens
  heavy chain complementarity determining region 3 for antibody 57262
AKALYSGSYYIFFDY

SEQ ID NO: 114525 - protein, 9 aa, Homo sapiens
  light chain complementarity determining region 3 for antibody 57263
LQDYNYPHT

SEQ ID NO: 114526 - protein, 10 aa, Homo sapiens
  heavy chain complementarity determining region 3 for antibody 57263
AISLAAPEDF

SEQ ID NO: 114527 - protein, 9 aa, Homo sapiens
  light chain complementarity determining region 3 for antibody 57264
QQYNSYPLT

SEQ ID NO: 114528 - protein, 9 aa, Homo sapiens
  heavy chain complementarity determining region 3 for antibody 57264
ARGKAAAGP

SEQ ID NO: 114529 - protein, 9 aa, Homo sapiens
  light chain complementarity determining region 3 for antibody 57265
QQLNSFPPT

SEQ ID NO: 114530 - protein, 17 aa, Homo sapiens
  heavy chain complementarity determining region 3 for antibody 57265
ARDPLYYYGSGSSGMDV

SEQ ID NO: 114531 - protein, 9 aa, Homo sapiens
  light chain complementarity determining region 3 for antibody 57266
LQDYNYPYT

SEQ ID NO: 114532 - protein, 14 aa, Homo sapiens
  heavy chain complementarity determining region 3 for antibody 57266
ARDRIQLWLPSFDY

SEQ ID NO: 114533 - protein, 9 aa, Homo sapiens
  light chain complementarity determining region 3 for antibody 57267
HQSSSLPHT

SEQ ID NO: 114534 - protein, 15 aa, Homo sapiens
  heavy chain complementarity determining region 3 for antibody 57267
AREWNDVLYYYGMDV

SEQ ID NO: 114535 - protein, 9 aa, Homo sapiens
  light chain complementarity determining region 3 for antibody 57268
QQYNSYPYT

SEQ ID NO: 114536 - protein, 12 aa, Homo sapiens
  heavy chain complementarity determining region 3 for antibody 57268
AREAAAGNWFDP

SEQ ID NO: 114537 - protein, 9 aa, Homo sapiens
  light chain complementarity determining region 3 for antibody 57269
HQSSSLPLT

SEQ ID NO: 114538 - protein, 16 aa, Homo sapiens
  heavy chain complementarity determining region 3 for antibody 57269
AREPLYDILTYDAFDI

SEQ ID NO: 114539 - protein, 9 aa, Homo sapiens
  light chain complementarity determining region 3 for antibody 57270
QQLNSYPIT

SEQ ID NO: 114540 - protein, 9 aa, Homo sapiens
  heavy chain complementarity determining region 3 for antibody 57270
ARKRGTFDI

SEQ ID NO: 114541 - protein, 9 aa, Homo sapiens
  light chain complementarity determining region 3 for antibody 57271
QQYNSFPYT

SEQ ID NO: 114542 - protein, 22 aa, Homo sapiens
  heavy chain complementarity determining region 3 for antibody 57271
ARDVRDYDILTGYYNGGNYFDY

SEQ ID NO: 114543 - protein, 9 aa, Homo sapiens
  light chain complementarity determining region 3 for antibody 57272
QQYGSSPYT

SEQ ID NO: 114544 - protein, 13 aa, Homo sapiens
  heavy chain complementarity determining region 3 for antibody 57272
AREGGYNFGPFDY

SEQ ID NO: 114545 - protein, 9 aa, Homo sapiens
  light chain complementarity determining region 3 for antibody 57273
QQLNSYPLT

SEQ ID NO: 114546 - protein, 14 aa, Homo sapiens
  heavy chain complementarity determining region 3 for antibody 57273
AREGTSYYYYGMDV

SEQ ID NO: 114547 - protein, 9 aa, Homo sapiens
  light chain complementarity determining region 3 for antibody 57274
QQLNSYPFT

SEQ ID NO: 114548 - protein, 15 aa, Homo sapiens
  heavy chain complementarity determining region 3 for antibody 57274
ARDYYYGSGSRWFDP

SEQ ID NO: 114549 - protein, 9 aa, Homo sapiens
  light chain complementarity determining region 3 for antibody 57275
QKYNSAPWT

SEQ ID NO: 114550 - protein, 15 aa, Homo sapiens
  heavy chain complementarity determining region 3 for antibody 57275
AEAGDYYGSGSPFDY

SEQ ID NO: 114551 - protein, 9 aa, Homo sapiens
  light chain complementarity determining region 3 for antibody 57276
LQHNSYPYT

SEQ ID NO: 114552 - protein, 12 aa, Homo sapiens
  heavy chain complementarity determining region 3 for antibody 57276
AEDRSYYYGMDV

SEQ ID NO: 114553 - protein, 9 aa, Homo sapiens
  light chain complementarity determining region 3 for antibody 57277
LQHNSYPLT

SEQ ID NO: 114554 - protein, 10 aa, Homo sapiens
  heavy chain complementarity determining region 3 for antibody 57277
AKEGYRSGDY

SEQ ID NO: 114555 - protein, 9 aa, Homo sapiens
  light chain complementarity determining region 3 for antibody 57278
LQDYNYPRT

SEQ ID NO: 114556 - protein, 17 aa, Homo sapiens
  heavy chain complementarity determining region 3 for antibody 57278
ARDESITMVRGVMGMDV

SEQ ID NO: 114557 - protein, 10 aa, Homo sapiens
  light chain complementarity determining region 3 for antibody 57279
QQYNTWPPLT

SEQ ID NO: 114558 - protein, 9 aa, Homo sapiens
  heavy chain complementarity determining region 3 for antibody 57279
ARGLGHFDY

SEQ ID NO: 114559 - protein, 9 aa, Homo sapiens
  light chain complementarity determining region 3 for antibody 57280
QQLNSYPRT

SEQ ID NO: 114560 - protein, 11 aa, Homo sapiens
  heavy chain complementarity determining region 3 for antibody 57280
ARDRSYYGMDV

SEQ ID NO: 114561 - protein, 9 aa, Homo sapiens
  light chain complementarity determining region 3 for antibody 57281
QKYNSAPWT

SEQ ID NO: 114562 - protein, 15 aa, Homo sapiens
  heavy chain complementarity determining region 3 for antibody 57281
AKAGDYCGSGSPFDY

SEQ ID NO: 114563 - protein, 9 aa, Homo sapiens
  light chain complementarity determining region 3 for antibody 57282
LQDYNYPWT

SEQ ID NO: 114564 - protein, 14 aa, Homo sapiens
  heavy chain complementarity determining region 3 for antibody 57282
ARGLLWFGGYVMDV

SEQ ID NO: 114565 - protein, 9 aa, Homo sapiens
  light chain complementarity determining region 3 for antibody 57283
LQDYNYPRT

SEQ ID NO: 114566 - protein, 14 aa, Homo sapiens
  heavy chain complementarity determining region 3 for antibody 57283
ARWDSSSWYDSFDI

SEQ ID NO: 114567 - protein, 9 aa, Homo sapiens
  light chain complementarity determining region 3 for antibody 57284
HQSSSLPHT

SEQ ID NO: 114568 - protein, 13 aa, Homo sapiens
  heavy chain complementarity determining region 3 for antibody 57284
ARGGYYGSGSLGY

SEQ ID NO: 114569 - protein, 10 aa, Homo sapiens
  light chain complementarity determining region 3 for antibody 57285
QQYNNWPPFT

SEQ ID NO: 114570 - protein, 10 aa, Homo sapiens
  heavy chain complementarity determining region 3 for antibody 57285
ARHPVAYFDY

SEQ ID NO: 114571 - protein, 9 aa, Homo sapiens
  light chain complementarity determining region 3 for antibody 57286
QQYDNLPYT

SEQ ID NO: 114572 - protein, 16 aa, Homo sapiens
  heavy chain complementarity determining region 3 for antibody 57286
AGGTVDRRYYYYGMDV

SEQ ID NO: 114573 - protein, 9 aa, Homo sapiens
  light chain complementarity determining region 3 for antibody 57287
LQHNSYPWT

SEQ ID NO: 114574 - protein, 13 aa, Homo sapiens
  heavy chain complementarity determining region 3 for antibody 57287
AREGDIVAKVFDY

SEQ ID NO: 114575 - protein, 9 aa, Homo sapiens
  light chain complementarity determining region 3 for antibody 57288
HQSSSLPYT

SEQ ID NO: 114576 - protein, 17 aa, Homo sapiens
  heavy chain complementarity determining region 3 for antibody 57288
AREDDILTGYYPFYFDY

SEQ ID NO: 114577 - protein, 9 aa, Homo sapiens
  light chain complementarity determining region 3 for antibody 57289
HQSSSLPFT

SEQ ID NO: 114578 - protein, 9 aa, Homo sapiens
  heavy chain complementarity determining region 3 for antibody 57289
ARDYGGFDY

SEQ ID NO: 114579 - protein, 9 aa, Homo sapiens
  light chain complementarity determining region 3 for antibody 57290
QQYGSSHYT

SEQ ID NO: 114580 - protein, 9 aa, Homo sapiens
  heavy chain complementarity determining region 3 for antibody 57290
AREAIGFDY

SEQ ID NO: 114581 - protein, 8 aa, Homo sapiens
  light chain complementarity determining region 3 for antibody 57291
QQDYNLFT

SEQ ID NO: 114582 - protein, 14 aa, Homo sapiens
  heavy chain complementarity determining region 3 for antibody 57291
AKQGSGKFGNGMDV

SEQ ID NO: 114583 - protein, 9 aa, Homo sapiens
  light chain complementarity determining region 3 for antibody 57292
QKYNSAPWT

SEQ ID NO: 114584 - protein, 15 aa, Homo sapiens
  heavy chain complementarity determining region 3 for antibody 57292
AKAGDYYGSGSPFAY

SEQ ID NO: 114585 - protein, 9 aa, Homo sapiens
  light chain complementarity determining region 3 for antibody 57293
LQHNSYPYT

SEQ ID NO: 114586 - protein, 13 aa, Homo sapiens
  heavy chain complementarity determining region 3 for antibody 57293
ARDRLTGDLFFDY

SEQ ID NO: 114587 - protein, 9 aa, Homo sapiens
  light chain complementarity determining region 3 for antibody 57294
LQDYNYPYT

SEQ ID NO: 114588 - protein, 18 aa, Homo sapiens
  heavy chain complementarity determining region 3 for antibody 57294
ARKSYFGSGIYYYYGMDV

SEQ ID NO: 114589 - protein, 9 aa, Homo sapiens
  light chain complementarity determining region 3 for antibody 57295
HQSSSLPLT

SEQ ID NO: 114590 - protein, 13 aa, Homo sapiens
  heavy chain complementarity determining region 3 for antibody 57295
ARGGYYGSGGLDY

SEQ ID NO: 114591 - protein, 9 aa, Homo sapiens
  light chain complementarity determining region 3 for antibody 57296
QQYYNTPRT

SEQ ID NO: 114592 - protein, 18 aa, Homo sapiens
  heavy chain complementarity determining region 3 for antibody 57296
AREGDSSGPFYYYYGMDV

SEQ ID NO: 114593 - protein, 9 aa, Homo sapiens
  light chain complementarity determining region 3 for antibody 57297
QQYNSYPYT

SEQ ID NO: 114594 - protein, 12 aa, Homo sapiens
  heavy chain complementarity determining region 3 for antibody 57297
ARVVGVWSPFDF

SEQ ID NO: 114595 - protein, 9 aa, Homo sapiens
  light chain complementarity determining region 3 for antibody 57298
MQALQTPLT

SEQ ID NO: 114596 - protein, 20 aa, Homo sapiens
  heavy chain complementarity determining region 3 for antibody 57298
ARVPLLWFGESFLDYYGMDV

SEQ ID NO: 114597 - protein, 9 aa, Homo sapiens
  light chain complementarity determining region 3 for antibody 57299
LQDYNYPYT

SEQ ID NO: 114598 - protein, 18 aa, Homo sapiens
  heavy chain complementarity determining region 3 for antibody 57299
ARERGLLWFGELRSGMDV

SEQ ID NO: 114599 - protein, 9 aa, Homo sapiens
  light chain complementarity determining region 3 for antibody 57300
HQSSSLPHT

SEQ ID NO: 114600 - protein, 13 aa, Homo sapiens
  heavy chain complementarity determining region 3 for antibody 57300
ARGGSYGSGSLDY

SEQ ID NO: 114601 - protein, 9 aa, Homo sapiens
  light chain complementarity determining region 3 for antibody 57301
QQYNSYPYT

SEQ ID NO: 114602 - protein, 11 aa, Homo sapiens
  heavy chain complementarity determining region 3 for antibody 57301
AREGSSGPFDY

SEQ ID NO: 114603 - protein, 9 aa, Homo sapiens
  light chain complementarity determining region 3 for antibody 57302
QQYNSYPPT

SEQ ID NO: 114604 - protein, 14 aa, Homo sapiens
  heavy chain complementarity determining region 3 for antibody 57302
ARDHSGSYFNWFDH

SEQ ID NO: 114605 - protein, 9 aa, Homo sapiens
  light chain complementarity determining region 3 for antibody 57303
QQLNSYPRT

SEQ ID NO: 114606 - protein, 11 aa, Homo sapiens
  heavy chain complementarity determining region 3 for antibody 57303
ARDRRSYGMDV

SEQ ID NO: 114607 - protein, 8 aa, Homo sapiens
  light chain complementarity determining region 3 for antibody 57304
QQFNNYPT

SEQ ID NO: 114608 - protein, 13 aa, Homo sapiens
  heavy chain complementarity determining region 3 for antibody 57304
ARDSSSWYEYFDL

SEQ ID NO: 114609 - protein, 9 aa, Homo sapiens
  light chain complementarity determining region 3 for antibody 57305
QKYNSAPWT

SEQ ID NO: 114610 - protein, 15 aa, Homo sapiens
  heavy chain complementarity determining region 3 for antibody 57305
AKAGDYYGSGSPFDD

SEQ ID NO: 114611 - protein, 9 aa, Homo sapiens
  light chain complementarity determining region 3 for antibody 57306
LQDYNYPWT

SEQ ID NO: 114612 - protein, 11 aa, Homo sapiens
  heavy chain complementarity determining region 3 for antibody 57306
ATGSPFLWFGD

SEQ ID NO: 114613 - protein, 9 aa, Homo sapiens
  light chain complementarity determining region 3 for antibody 57307
QQYNSYPLT

SEQ ID NO: 114614 - protein, 9 aa, Homo sapiens
  heavy chain complementarity determining region 3 for antibody 57307
ARNCFFFDY

SEQ ID NO: 114615 - protein, 9 aa, Homo sapiens
  light chain complementarity determining region 3 for antibody 57308
QQFNNYIFT

SEQ ID NO: 114616 - protein, 22 aa, Homo sapiens
  heavy chain complementarity determining region 3 for antibody 57308
ARDRHYYGSGSYSYYYYYGMDV

SEQ ID NO: 114617 - protein, 9 aa, Homo sapiens
  light chain complementarity determining region 3 for antibody 57309
LQDYNYPYT

SEQ ID NO: 114618 - protein, 17 aa, Homo sapiens
  heavy chain complementarity determining region 3 for antibody 57309
AKHDILAGYYSVGYFDL

SEQ ID NO: 114619 - protein, 9 aa, Homo sapiens
  light chain complementarity determining region 3 for antibody 57310
LQDYNYPWT

SEQ ID NO: 114620 - protein, 6 aa, Homo sapiens
  heavy chain complementarity determining region 3 for antibody 57310
AAWVDY

SEQ ID NO: 114621 - protein, 9 aa, Homo sapiens
  light chain complementarity determining region 3 for antibody 57311
HQSSSLPHT

SEQ ID NO: 114622 - protein, 13 aa, Homo sapiens
  heavy chain complementarity determining region 3 for antibody 57311
ARGGYSGSGSLDY

SEQ ID NO: 114623 - protein, 9 aa, Homo sapiens
  light chain complementarity determining region 3 for antibody 57312
QKYNSAPWT

SEQ ID NO: 114624 - protein, 15 aa, Homo sapiens
  heavy chain complementarity determining region 3 for antibody 57312
AKAGDYYGSCSPFDY

SEQ ID NO: 114625 - protein, 9 aa, Homo sapiens
  light chain complementarity determining region 3 for antibody 57313
LQDYNYPWT

SEQ ID NO: 114626 - protein, 11 aa, Homo sapiens
  heavy chain complementarity determining region 3 for antibody 57313
ATGSPLRWFGD

SEQ ID NO: 114627 - protein, 9 aa, Homo sapiens
  light chain complementarity determining region 3 for antibody 57314
HQSSSLPRT

SEQ ID NO: 114628 - protein, 12 aa, Homo sapiens
  heavy chain complementarity determining region 3 for antibody 57314
ARDRDYYDVLDY

SEQ ID NO: 114629 - protein, 9 aa, Homo sapiens
  light chain complementarity determining region 3 for antibody 57315
RKYNSAPWT

SEQ ID NO: 114630 - protein, 15 aa, Homo sapiens
  heavy chain complementarity determining region 3 for antibody 57315
AKAGDYYGSGSPFDY

SEQ ID NO: 114631 - protein, 8 aa, Homo sapiens
  light chain complementarity determining region 3 for antibody 57316
QQDYYLFT

SEQ ID NO: 114632 - protein, 15 aa, Homo sapiens
  heavy chain complementarity determining region 3 for antibody 57316
AKGTAPTYFYNGLDV

SEQ ID NO: 114633 - protein, 9 aa, Homo sapiens
  light chain complementarity determining region 3 for antibody 57317
LRDYNYPWT

SEQ ID NO: 114634 - protein, 14 aa, Homo sapiens
  heavy chain complementarity determining region 3 for antibody 57317
AGRHYDILTGFSDY

SEQ ID NO: 114635 - protein, 9 aa, Homo sapiens
  light chain complementarity determining region 3 for antibody 57318
LQDYNYPRT

SEQ ID NO: 114636 - protein, 12 aa, Homo sapiens
  heavy chain complementarity determining region 3 for antibody 57318
ARGIAVAGEFDY

SEQ ID NO: 114637 - protein, 9 aa, Homo sapiens
  light chain complementarity determining region 3 for antibody 57319
QQYNSYPLT

SEQ ID NO: 114638 - protein, 11 aa, Homo sapiens
  heavy chain complementarity determining region 3 for antibody 57319
ARGRGAAAGDY

SEQ ID NO: 114639 - protein, 9 aa, Homo sapiens
  light chain complementarity determining region 3 for antibody 57320
QQYNNWPRT

SEQ ID NO: 114640 - protein, 15 aa, Homo sapiens
  heavy chain complementarity determining region 3 for antibody 57320
AKEGATRYYYYGMDV

SEQ ID NO: 114641 - protein, 9 aa, Homo sapiens
  light chain complementarity determining region 3 for antibody 57321
QQSYSTPYT

SEQ ID NO: 114642 - protein, 14 aa, Homo sapiens
  heavy chain complementarity determining region 3 for antibody 57321
ARGGYGSGSYLFDY

SEQ ID NO: 114643 - protein, 9 aa, Homo sapiens
  light chain complementarity determining region 3 for antibody 57322
QQRSNWPHT

SEQ ID NO: 114644 - protein, 16 aa, Homo sapiens
  heavy chain complementarity determining region 3 for antibody 57322
ARDGAVTPYYYYGMDV

SEQ ID NO: 114645 - protein, 9 aa, Homo sapiens
  light chain complementarity determining region 3 for antibody 57323
QQFNNYPYT

SEQ ID NO: 114646 - protein, 17 aa, Homo sapiens
  heavy chain complementarity determining region 3 for antibody 57323
AREGYYYGSGSYYAFDY

SEQ ID NO: 114647 - protein, 10 aa, Homo sapiens
  light chain complementarity determining region 3 for antibody 57324
QQFNNYPMYT

SEQ ID NO: 114648 - protein, 11 aa, Homo sapiens
  heavy chain complementarity determining region 3 for antibody 57324
ARQIVGAFFDY

SEQ ID NO: 114649 - protein, 9 aa, Homo sapiens
  light chain complementarity determining region 3 for antibody 57325
QKYNSAPWT

SEQ ID NO: 114650 - protein, 15 aa, Homo sapiens
  heavy chain complementarity determining region 3 for antibody 57325
AKAGDYYGSGCPFDY

SEQ ID NO: 114651 - protein, 9 aa, Homo sapiens
  light chain complementarity determining region 3 for antibody 57326
QKYNSAPWA

SEQ ID NO: 114652 - protein, 15 aa, Homo sapiens
  heavy chain complementarity determining region 3 for antibody 57326
AKAGDYYGSGSPFDY

SEQ ID NO: 114653 - protein, 9 aa, Homo sapiens
  light chain complementarity determining region 3 for antibody 57327
LQDYNYPWT

SEQ ID NO: 114654 - protein, 13 aa, Homo sapiens
  heavy chain complementarity determining region 3 for antibody 57327
AKVWSSGWSDLDY

SEQ ID NO: 114655 - protein, 10 aa, Homo sapiens
  light chain complementarity determining region 3 for antibody 57328
QQYGSSPPWT

SEQ ID NO: 114656 - protein, 14 aa, Homo sapiens
  heavy chain complementarity determining region 3 for antibody 57328
AGGPYYYGSGTYYK

SEQ ID NO: 114657 - protein, 9 aa, Homo sapiens
  light chain complementarity determining region 3 for antibody 57329
QQLNSYPLT

SEQ ID NO: 114658 - protein, 12 aa, Homo sapiens
  heavy chain complementarity determining region 3 for antibody 57329
ARMVRGVTPFDY

SEQ ID NO: 114659 - protein, 9 aa, Homo sapiens
  light chain complementarity determining region 3 for antibody 57330
QQFNNYPLT

SEQ ID NO: 114660 - protein, 11 aa, Homo sapiens
  heavy chain complementarity determining region 3 for antibody 57330
ARCNWNDYFDY

SEQ ID NO: 114661 - protein, 9 aa, Homo sapiens
  light chain complementarity determining region 3 for antibody 57331
QKYNSAPWT

SEQ ID NO: 114662 - protein, 15 aa, Homo sapiens
  heavy chain complementarity determining region 3 for antibody 57331
AKAGDDYGSGSPFDY

SEQ ID NO: 114663 - protein, 9 aa, Homo sapiens
  light chain complementarity determining region 3 for antibody 57332
LQDYNYPWT

SEQ ID NO: 114664 - protein, 13 aa, Homo sapiens
  heavy chain complementarity determining region 3 for antibody 57332
ARDPSPRYYGMDV

SEQ ID NO: 114665 - protein, 9 aa, Homo sapiens
  light chain complementarity determining region 3 for antibody 57333
LQDYNYPRT

SEQ ID NO: 114666 - protein, 14 aa, Homo sapiens
  heavy chain complementarity determining region 3 for antibody 57333
ARWDSSSWYDTFDI

SEQ ID NO: 114667 - protein, 9 aa, Homo sapiens
  light chain complementarity determining region 3 for antibody 57334
QQYGSSPYT

SEQ ID NO: 114668 - protein, 16 aa, Homo sapiens
  heavy chain complementarity determining region 3 for antibody 57334
ARSLLRYFDFRNYFDY

SEQ ID NO: 114669 - protein, 10 aa, Homo sapiens
  light chain complementarity determining region 3 for antibody 57335
QQYGSSPPYT

SEQ ID NO: 114670 - protein, 12 aa, Homo sapiens
  heavy chain complementarity determining region 3 for antibody 57335
TADYYSYYGMDV

SEQ ID NO: 114671 - protein, 9 aa, Homo sapiens
  light chain complementarity determining region 3 for antibody 57336
QQLNSYPRT

SEQ ID NO: 114672 - protein, 18 aa, Homo sapiens
  heavy chain complementarity determining region 3 for antibody 57336
ARGDYDILTGYYKDAFDI

SEQ ID NO: 114673 - protein, 9 aa, Homo sapiens
  light chain complementarity determining region 3 for antibody 57337
QQLHSYPFT

SEQ ID NO: 114674 - protein, 15 aa, Homo sapiens
  heavy chain complementarity determining region 3 for antibody 57337
ARDDTGYYYYYGMDV

SEQ ID NO: 114675 - protein, 9 aa, Homo sapiens
  light chain complementarity determining region 3 for antibody 57338
QKYNSAPWT

SEQ ID NO: 114676 - protein, 15 aa, Homo sapiens
  heavy chain complementarity determining region 3 for antibody 57338
AKAGDSYGSGSPFDY

SEQ ID NO: 114677 - protein, 9 aa, Homo sapiens
  light chain complementarity determining region 3 for antibody 57339
LQHNSYPYT

SEQ ID NO: 114678 - protein, 20 aa, Homo sapiens
  heavy chain complementarity determining region 3 for antibody 57339
ARDGDDILTGYYYYYYGMDV

SEQ ID NO: 114679 - protein, 9 aa, Homo sapiens
  light chain complementarity determining region 3 for antibody 57340
LQHNSYPYT

SEQ ID NO: 114680 - protein, 12 aa, Homo sapiens
  heavy chain complementarity determining region 3 for antibody 57340
AKDRSYSYGMDV

SEQ ID NO: 114681 - protein, 9 aa, Homo sapiens
  light chain complementarity determining region 3 for antibody 57341
HQSSSLPLT

SEQ ID NO: 114682 - protein, 13 aa, Homo sapiens
  heavy chain complementarity determining region 3 for antibody 57341
ARGGYYGSGSLDC

SEQ ID NO: 114683 - protein, 9 aa, Homo sapiens
  light chain complementarity determining region 3 for antibody 57342
QQYYSYPWT

SEQ ID NO: 114684 - protein, 9 aa, Homo sapiens
  heavy chain complementarity determining region 3 for antibody 57342
ARGWGYKDY

SEQ ID NO: 114685 - protein, 9 aa, Homo sapiens
  light chain complementarity determining region 3 for antibody 57343
QQYNSYSYT

SEQ ID NO: 114686 - protein, 15 aa, Homo sapiens
  heavy chain complementarity determining region 3 for antibody 57343
ATGVRGVPNYYGLDV

SEQ ID NO: 114687 - protein, 9 aa, Homo sapiens
  light chain complementarity determining region 3 for antibody 57344
QQYNNWPYT

SEQ ID NO: 114688 - protein, 18 aa, Homo sapiens
  heavy chain complementarity determining region 3 for antibody 57344
AKDRLAYCGGDCYSNFDY

SEQ ID NO: 114689 - protein, 8 aa, Homo sapiens
  light chain complementarity determining region 3 for antibody 57345
QQYGSSPT

SEQ ID NO: 114690 - protein, 15 aa, Homo sapiens
  heavy chain complementarity determining region 3 for antibody 57345
AKDRQNYYGSGSFDY

SEQ ID NO: 114691 - protein, 9 aa, Homo sapiens
  light chain complementarity determining region 3 for antibody 57346
QQLSSYPLT

SEQ ID NO: 114692 - protein, 12 aa, Homo sapiens
  heavy chain complementarity determining region 3 for antibody 57346
ARMVRGVIPFDY

SEQ ID NO: 114693 - protein, 9 aa, Homo sapiens
  light chain complementarity determining region 3 for antibody 57347
QQLNTYPLT

SEQ ID NO: 114694 - protein, 16 aa, Homo sapiens
  heavy chain complementarity determining region 3 for antibody 57347
AREGITMVRGVIRFDY

SEQ ID NO: 114695 - protein, 9 aa, Homo sapiens
  light chain complementarity determining region 3 for antibody 57348
QQFNNYAYT

SEQ ID NO: 114696 - protein, 14 aa, Homo sapiens
  heavy chain complementarity determining region 3 for antibody 57348
ARRFRISVAAPFDY

SEQ ID NO: 114697 - protein, 9 aa, Homo sapiens
  light chain complementarity determining region 3 for antibody 57349
QKYNSAPWT

SEQ ID NO: 114698 - protein, 15 aa, Homo sapiens
  heavy chain complementarity determining region 3 for antibody 57349
AKAGDYYGPGSPFDY

SEQ ID NO: 114699 - protein, 9 aa, Homo sapiens
  light chain complementarity determining region 3 for antibody 57350
QKYNSAPLT

SEQ ID NO: 114700 - protein, 11 aa, Homo sapiens
  heavy chain complementarity determining region 3 for antibody 57350
AREAIVGAIDY

SEQ ID NO: 114701 - protein, 9 aa, Homo sapiens
  light chain complementarity determining region 3 for antibody 57351
MQSLQTPYT

SEQ ID NO: 114702 - protein, 14 aa, Homo sapiens
  heavy chain complementarity determining region 3 for antibody 57351
ARSSGSYYYYGMDV

SEQ ID NO: 114703 - protein, 9 aa, Homo sapiens
  light chain complementarity determining region 3 for antibody 57352
MQALQTPLT

SEQ ID NO: 114704 - protein, 10 aa, Homo sapiens
  heavy chain complementarity determining region 3 for antibody 57352
ARDRVGTTRY

SEQ ID NO: 114705 - protein, 9 aa, Homo sapiens
  light chain complementarity determining region 3 for antibody 57353
LQNYNYPYT

SEQ ID NO: 114706 - protein, 13 aa, Homo sapiens
  heavy chain complementarity determining region 3 for antibody 57353
ARDLAVAGYPFDY

SEQ ID NO: 114707 - protein, 9 aa, Homo sapiens
  light chain complementarity determining region 3 for antibody 57354
LQHNSYPWT

SEQ ID NO: 114708 - protein, 12 aa, Homo sapiens
  heavy chain complementarity determining region 3 for antibody 57354
ARGYSGYDSFDY

SEQ ID NO: 114709 - protein, 9 aa, Homo sapiens
  light chain complementarity determining region 3 for antibody 57355
LQDYNYPLT

SEQ ID NO: 114710 - protein, 13 aa, Homo sapiens
  heavy chain complementarity determining region 3 for antibody 57355
ATHYDILTGYFDY

SEQ ID NO: 114711 - protein, 9 aa, Homo sapiens
  light chain complementarity determining region 3 for antibody 57356
HQSSSLPNT

SEQ ID NO: 114712 - protein, 11 aa, Homo sapiens
  heavy chain complementarity determining region 3 for antibody 57356
ARGSGYNWFDL

SEQ ID NO: 114713 - protein, 7 aa, Homo sapiens
  light chain complementarity determining region 3 for antibody 57357
QQYNSYS

SEQ ID NO: 114714 - protein, 9 aa, Homo sapiens
  heavy chain complementarity determining region 3 for antibody 57357
ARDLGGIDY

SEQ ID NO: 114715 - protein, 8 aa, Homo sapiens
  light chain complementarity determining region 3 for antibody 57358
QQYGSSYT

SEQ ID NO: 114716 - protein, 20 aa, Homo sapiens
  heavy chain complementarity determining region 3 for antibody 57358
ARDRVLWFGELSPYYYGMDV

SEQ ID NO: 114717 - protein, 9 aa, Homo sapiens
  light chain complementarity determining region 3 for antibody 57359
QQLNTYPWT

SEQ ID NO: 114718 - protein, 19 aa, Homo sapiens
  heavy chain complementarity determining region 3 for antibody 57359
ARGGSGYDSLTGFPYGLDV

SEQ ID NO: 114719 - protein, 9 aa, Homo sapiens
  light chain complementarity determining region 3 for antibody 57360
QQFNNYPLT

SEQ ID NO: 114720 - protein, 22 aa, Homo sapiens
  heavy chain complementarity determining region 3 for antibody 57360
AKQSHYYDSESYRHYYYYGMDV

SEQ ID NO: 114721 - protein, 7 aa, Homo sapiens
  light chain complementarity determining region 3 for antibody 57361
QQFFNWT

SEQ ID NO: 114722 - protein, 11 aa, Homo sapiens
  heavy chain complementarity determining region 3 for antibody 57361
ARDPSIAAVDY

SEQ ID NO: 114723 - protein, 9 aa, Homo sapiens
  light chain complementarity determining region 3 for antibody 57362
QKYNSAPWT

SEQ ID NO: 114724 - protein, 15 aa, Homo sapiens
  heavy chain complementarity determining region 3 for antibody 57362
ANAGDYYGSGSPFDY

SEQ ID NO: 114725 - protein, 9 aa, Homo sapiens
  light chain complementarity determining region 3 for antibody 57363
QKYNSAPWT

SEQ ID NO: 114726 - protein, 15 aa, Homo sapiens
  heavy chain complementarity determining region 3 for antibody 57363
AKAGDYYGSGSPFGY

SEQ ID NO: 114727 - protein, 9 aa, Homo sapiens
  light chain complementarity determining region 3 for antibody 57364
LQHDNFPYT

SEQ ID NO: 114728 - protein, 13 aa, Homo sapiens
  heavy chain complementarity determining region 3 for antibody 57364
ARDQDYGSGSPDY

SEQ ID NO: 114729 - protein, 9 aa, Homo sapiens
  light chain complementarity determining region 3 for antibody 57365
LQDYNYPYT

SEQ ID NO: 114730 - protein, 16 aa, Homo sapiens
  heavy chain complementarity determining region 3 for antibody 57365
ARETPNYGFFYYGMDV

SEQ ID NO: 114731 - protein, 9 aa, Homo sapiens
  light chain complementarity determining region 3 for antibody 57366
HQSSSLPYT

SEQ ID NO: 114732 - protein, 11 aa, Homo sapiens
  heavy chain complementarity determining region 3 for antibody 57366
ARCNWNDYFDY

SEQ ID NO: 114733 - protein, 9 aa, Homo sapiens
  light chain complementarity determining region 3 for antibody 57367
QQYGSSPYT

SEQ ID NO: 114734 - protein, 16 aa, Homo sapiens
  heavy chain complementarity determining region 3 for antibody 57367
AKGGCSSTSCRGYFDY

SEQ ID NO: 114735 - protein, 9 aa, Homo sapiens
  light chain complementarity determining region 3 for antibody 57368
QQYGSSPWT

SEQ ID NO: 114736 - protein, 13 aa, Homo sapiens
  heavy chain complementarity determining region 3 for antibody 57368
ARHVRGVRGVMDV

SEQ ID NO: 114737 - protein, 8 aa, Homo sapiens
  light chain complementarity determining region 3 for antibody 57369
QQFNSYPT

SEQ ID NO: 114738 - protein, 13 aa, Homo sapiens
  heavy chain complementarity determining region 3 for antibody 57369
ARDVTGATSGFDY

SEQ ID NO: 114739 - protein, 9 aa, Homo sapiens
  light chain complementarity determining region 3 for antibody 57370
QQDYNLPIS

SEQ ID NO: 114740 - protein, 17 aa, Homo sapiens
  heavy chain complementarity determining region 3 for antibody 57370
AKDTRILTGNYYYGMDV

SEQ ID NO: 114741 - protein, 9 aa, Homo sapiens
  light chain complementarity determining region 3 for antibody 57371
LQHGSYPLT

SEQ ID NO: 114742 - protein, 13 aa, Homo sapiens
  heavy chain complementarity determining region 3 for antibody 57371
ARALRYFDWPFDY

SEQ ID NO: 114743 - protein, 9 aa, Homo sapiens
  light chain complementarity determining region 3 for antibody 57372
LQDYSYPWT

SEQ ID NO: 114744 - protein, 13 aa, Homo sapiens
  heavy chain complementarity determining region 3 for antibody 57372
ARVRITGTYAFDI

SEQ ID NO: 114745 - protein, 9 aa, Homo sapiens
  light chain complementarity determining region 3 for antibody 57373
LQDYNYPWT

SEQ ID NO: 114746 - protein, 13 aa, Homo sapiens
  heavy chain complementarity determining region 3 for antibody 57373
ARGMIRGEEYFDY

SEQ ID NO: 114747 - protein, 9 aa, Homo sapiens
  light chain complementarity determining region 3 for antibody 57374
HQSSSLPHT

SEQ ID NO: 114748 - protein, 13 aa, Homo sapiens
  heavy chain complementarity determining region 3 for antibody 57374
ARGGYDGSGSLDY

SEQ ID NO: 114749 - protein, 9 aa, Homo sapiens
  light chain complementarity determining region 3 for antibody 57375
QQYGSSPIT

SEQ ID NO: 114750 - protein, 13 aa, Homo sapiens
  heavy chain complementarity determining region 3 for antibody 57375
ARDPNWNDGAFDI

SEQ ID NO: 114751 - protein, 9 aa, Homo sapiens
  light chain complementarity determining region 3 for antibody 57376
QQLNSYPRT

SEQ ID NO: 114752 - protein, 18 aa, Homo sapiens
  heavy chain complementarity determining region 3 for antibody 57376
ARNYDILTGYYTDDAFDI

SEQ ID NO: 114753 - protein, 9 aa, Homo sapiens
  light chain complementarity determining region 3 for antibody 57377
QQLNSYPRT

SEQ ID NO: 114754 - protein, 11 aa, Homo sapiens
  heavy chain complementarity determining region 3 for antibody 57377
AREPYYYGMDV

SEQ ID NO: 114755 - protein, 9 aa, Homo sapiens
  light chain complementarity determining region 3 for antibody 57378
QKYNSAPWT

SEQ ID NO: 114756 - protein, 15 aa, Homo sapiens
  heavy chain complementarity determining region 3 for antibody 57378
AKAGDYYGSESPFDY

SEQ ID NO: 114757 - protein, 9 aa, Homo sapiens
  light chain complementarity determining region 3 for antibody 57379
QKYNSALWT

SEQ ID NO: 114758 - protein, 15 aa, Homo sapiens
  heavy chain complementarity determining region 3 for antibody 57379
AKAGDYYGSGSPFDY

SEQ ID NO: 114759 - protein, 9 aa, Homo sapiens
  light chain complementarity determining region 3 for antibody 57380
LQNYNYPYT

SEQ ID NO: 114760 - protein, 13 aa, Homo sapiens
  heavy chain complementarity determining region 3 for antibody 57380
ARDLAVASYPFDF

SEQ ID NO: 114761 - protein, 9 aa, Homo sapiens
  light chain complementarity determining region 3 for antibody 57381
LQHDNFPLT

SEQ ID NO: 114762 - protein, 22 aa, Homo sapiens
  heavy chain complementarity determining region 3 for antibody 57381
ARDVRDYDILTGYYNGKNYFDY

SEQ ID NO: 114763 - protein, 9 aa, Homo sapiens
  light chain complementarity determining region 3 for antibody 57382
LQDYNYPWT

SEQ ID NO: 114764 - protein, 13 aa, Homo sapiens
  heavy chain complementarity determining region 3 for antibody 57382
ARDGGIAVAGPDY

SEQ ID NO: 114765 - protein, 9 aa, Homo sapiens
  light chain complementarity determining region 3 for antibody 57383
HQSSSLPYT

SEQ ID NO: 114766 - protein, 10 aa, Homo sapiens
  heavy chain complementarity determining region 3 for antibody 57383
SRDGQWLGDY

SEQ ID NO: 114767 - protein, 9 aa, Homo sapiens
  light chain complementarity determining region 3 for antibody 57384
HQSSSLPWT

SEQ ID NO: 114768 - protein, 12 aa, Homo sapiens
  heavy chain complementarity determining region 3 for antibody 57384
AREGNWGSDFDY

SEQ ID NO: 114769 - protein, 9 aa, Homo sapiens
  light chain complementarity determining region 3 for antibody 57385
HQSSSLPHT

SEQ ID NO: 114770 - protein, 13 aa, Homo sapiens
  heavy chain complementarity determining region 3 for antibody 57385
ARGGYYVSGSLDY

SEQ ID NO: 114771 - protein, 9 aa, Homo sapiens
  light chain complementarity determining region 3 for antibody 57386
QQYNSYPYT

SEQ ID NO: 114772 - protein, 18 aa, Homo sapiens
  heavy chain complementarity determining region 3 for antibody 57386
AREGDYYGSGSYEDWFDP

SEQ ID NO: 114773 - protein, 9 aa, Homo sapiens
  light chain complementarity determining region 3 for antibody 57387
QQYGSSPYT

SEQ ID NO: 114774 - protein, 16 aa, Homo sapiens
  heavy chain complementarity determining region 3 for antibody 57387
ARGLLLWFGDPNWFDP

SEQ ID NO: 114775 - protein, 9 aa, Homo sapiens
  light chain complementarity determining region 3 for antibody 57388
QQLNTYPLT

SEQ ID NO: 114776 - protein, 9 aa, Homo sapiens
  heavy chain complementarity determining region 3 for antibody 57388
ARKKGTFGY

SEQ ID NO: 114777 - protein, 7 aa, Homo sapiens
  light chain complementarity determining region 3 for antibody 57389
QQDYNWT

SEQ ID NO: 114778 - protein, 11 aa, Homo sapiens
  heavy chain complementarity determining region 3 for antibody 57389
AKAGGLTPFDY

SEQ ID NO: 114779 - protein, 9 aa, Homo sapiens
  light chain complementarity determining region 3 for antibody 57390
QKYNSAPWT

SEQ ID NO: 114780 - protein, 15 aa, Homo sapiens
  heavy chain complementarity determining region 3 for antibody 57390
AKAGDYYASGSPFDY

SEQ ID NO: 114781 - protein, 9 aa, Homo sapiens
  light chain complementarity determining region 3 for antibody 57391
QEYNSAPWT

SEQ ID NO: 114782 - protein, 15 aa, Homo sapiens
  heavy chain complementarity determining region 3 for antibody 57391
AKAGDYYGSGSPFDY

SEQ ID NO: 114783 - protein, 9 aa, Homo sapiens
  light chain complementarity determining region 3 for antibody 57392
LQYNSYPCT

SEQ ID NO: 114784 - protein, 7 aa, Homo sapiens
  heavy chain complementarity determining region 3 for antibody 57392
ARGDFDL

SEQ ID NO: 114785 - protein, 9 aa, Homo sapiens
  light chain complementarity determining region 3 for antibody 57393
LQHNSYPYT

SEQ ID NO: 114786 - protein, 16 aa, Homo sapiens
  heavy chain complementarity determining region 3 for antibody 57393
AKDGSGSYYLTEYFHH

SEQ ID NO: 114787 - protein, 9 aa, Homo sapiens
  light chain complementarity determining region 3 for antibody 57394
LQDYNYPYT

SEQ ID NO: 114788 - protein, 22 aa, Homo sapiens
  heavy chain complementarity determining region 3 for antibody 57394
AREAPLSRLGALSYGGYYGMDV

SEQ ID NO: 114789 - protein, 9 aa, Homo sapiens
  light chain complementarity determining region 3 for antibody 57395
LQDYNYPWT

SEQ ID NO: 114790 - protein, 15 aa, Homo sapiens
  heavy chain complementarity determining region 3 for antibody 57395
ARDPYYSINWSPFDY

SEQ ID NO: 114791 - protein, 9 aa, Homo sapiens
  light chain complementarity determining region 3 for antibody 57396
QQLNSYPYT

SEQ ID NO: 114792 - protein, 15 aa, Homo sapiens
  heavy chain complementarity determining region 3 for antibody 57396
ARLFRYSGTSDAFDI

SEQ ID NO: 114793 - protein, 9 aa, Homo sapiens
  light chain complementarity determining region 3 for antibody 57397
QQLNSYPRT

SEQ ID NO: 114794 - protein, 15 aa, Homo sapiens
  heavy chain complementarity determining region 3 for antibody 57397
ARENGDNYYYYGMDV

SEQ ID NO: 114795 - protein, 9 aa, Homo sapiens
  light chain complementarity determining region 3 for antibody 57398
QQLNSYPLT

SEQ ID NO: 114796 - protein, 9 aa, Homo sapiens
  heavy chain complementarity determining region 3 for antibody 57398
ARKKGTFDY

SEQ ID NO: 114797 - protein, 9 aa, Homo sapiens
  light chain complementarity determining region 3 for antibody 57399
QKYNSAPWT

SEQ ID NO: 114798 - protein, 15 aa, Homo sapiens
  heavy chain complementarity determining region 3 for antibody 57399
AKAGDYYGSVSPFDY

SEQ ID NO: 114799 - protein, 9 aa, Homo sapiens
  light chain complementarity determining region 3 for antibody 57400
MQALQTPLT

SEQ ID NO: 114800 - protein, 10 aa, Homo sapiens
  heavy chain complementarity determining region 3 for antibody 57400
ARDRVGATRS

SEQ ID NO: 114801 - protein, 9 aa, Homo sapiens
  light chain complementarity determining region 3 for antibody 57401
LQHNSYPYT

SEQ ID NO: 114802 - protein, 12 aa, Homo sapiens
  heavy chain complementarity determining region 3 for antibody 57401
AKERSYYYGMDV

SEQ ID NO: 114803 - protein, 9 aa, Homo sapiens
  light chain complementarity determining region 3 for antibody 57402
LQHNSYPFT

SEQ ID NO: 114804 - protein, 10 aa, Homo sapiens
  heavy chain complementarity determining region 3 for antibody 57402
ARDSSGGLDY

SEQ ID NO: 114805 - protein, 9 aa, Homo sapiens
  light chain complementarity determining region 3 for antibody 57403
LQDYNYPYT

SEQ ID NO: 114806 - protein, 12 aa, Homo sapiens
  heavy chain complementarity determining region 3 for antibody 57403
AREGVRGAHFDY

SEQ ID NO: 114807 - protein, 9 aa, Homo sapiens
  light chain complementarity determining region 3 for antibody 57404
HQSSSLPWT

SEQ ID NO: 114808 - protein, 16 aa, Homo sapiens
  heavy chain complementarity determining region 3 for antibody 57404
ATDDYYDSSGYRWFDP

SEQ ID NO: 114809 - protein, 9 aa, Homo sapiens
  light chain complementarity determining region 3 for antibody 57405
HQSSSLPHT

SEQ ID NO: 114810 - protein, 13 aa, Homo sapiens
  heavy chain complementarity determining region 3 for antibody 57405
ARGGCYGSGSLDY

SEQ ID NO: 114811 - protein, 9 aa, Homo sapiens
  light chain complementarity determining region 3 for antibody 57406
QQYNSYPFT

SEQ ID NO: 114812 - protein, 14 aa, Homo sapiens
  heavy chain complementarity determining region 3 for antibody 57406
AREGNYYYYYGMDV

SEQ ID NO: 114813 - protein, 9 aa, Homo sapiens
  light chain complementarity determining region 3 for antibody 57407
QQYGTSPWT

SEQ ID NO: 114814 - protein, 18 aa, Homo sapiens
  heavy chain complementarity determining region 3 for antibody 57407
ARGGLRYFGSGSYYLFDY

SEQ ID NO: 114815 - protein, 9 aa, Homo sapiens
  light chain complementarity determining region 3 for antibody 57408
QQYGSSPRT

SEQ ID NO: 114816 - protein, 11 aa, Homo sapiens
  heavy chain complementarity determining region 3 for antibody 57408
ARYNSYWYFDL

SEQ ID NO: 114817 - protein, 9 aa, Homo sapiens
  light chain complementarity determining region 3 for antibody 57409
QQYGSSPLT

SEQ ID NO: 114818 - protein, 13 aa, Homo sapiens
  heavy chain complementarity determining region 3 for antibody 57409
ARDRGFGEFHFDH

SEQ ID NO: 114819 - protein, 8 aa, Homo sapiens
  light chain complementarity determining region 3 for antibody 57410
QQYGSSFT

SEQ ID NO: 114820 - protein, 10 aa, Homo sapiens
  heavy chain complementarity determining region 3 for antibody 57410
ARGAYYGMDV

SEQ ID NO: 114821 - protein, 9 aa, Homo sapiens
  light chain complementarity determining region 3 for antibody 57411
QQLNSYPWT

SEQ ID NO: 114822 - protein, 17 aa, Homo sapiens
  heavy chain complementarity determining region 3 for antibody 57411
AKATVDIGPYYYYAMDV

SEQ ID NO: 114823 - protein, 9 aa, Homo sapiens
  light chain complementarity determining region 3 for antibody 57412
QQLNSYPRT

SEQ ID NO: 114824 - protein, 11 aa, Homo sapiens
  heavy chain complementarity determining region 3 for antibody 57412
ARGRRYYGMDV

SEQ ID NO: 114825 - protein, 9 aa, Homo sapiens
  light chain complementarity determining region 3 for antibody 57413
QQLNSYPPT

SEQ ID NO: 114826 - protein, 11 aa, Homo sapiens
  heavy chain complementarity determining region 3 for antibody 57413
ARDAVAVAFDY

SEQ ID NO: 114827 - protein, 9 aa, Homo sapiens
  light chain complementarity determining region 3 for antibody 57414
QQFNNYPLT

SEQ ID NO: 114828 - protein, 7 aa, Homo sapiens
  heavy chain complementarity determining region 3 for antibody 57414
ARGSGNY

SEQ ID NO: 114829 - protein, 8 aa, Homo sapiens
  light chain complementarity determining region 3 for antibody 57415
QQDYNLYT

SEQ ID NO: 114830 - protein, 17 aa, Homo sapiens
  heavy chain complementarity determining region 3 for antibody 57415
ARWAPMVRGLNYYGMDV

SEQ ID NO: 114831 - protein, 8 aa, Homo sapiens
  light chain complementarity determining region 3 for antibody 57416
QQDYNLYT

SEQ ID NO: 114832 - protein, 16 aa, Homo sapiens
  heavy chain complementarity determining region 3 for antibody 57416
ARGSNSLAYYYYGMDV

SEQ ID NO: 114833 - protein, 9 aa, Homo sapiens
  light chain complementarity determining region 3 for antibody 57417
QQDYNLPYT

SEQ ID NO: 114834 - protein, 13 aa, Homo sapiens
  heavy chain complementarity determining region 3 for antibody 57417
ARAIAAASTLFDY

SEQ ID NO: 114835 - protein, 9 aa, Homo sapiens
  light chain complementarity determining region 3 for antibody 57418
QKYNSAPWT

SEQ ID NO: 114836 - protein, 15 aa, Homo sapiens
  heavy chain complementarity determining region 3 for antibody 57418
AKVGDYYGSGSPFDY

SEQ ID NO: 114837 - protein, 9 aa, Homo sapiens
  light chain complementarity determining region 3 for antibody 57419
QKYNSAPWT

SEQ ID NO: 114838 - protein, 15 aa, Homo sapiens
  heavy chain complementarity determining region 3 for antibody 57419
AKAGDYYGSGSPFDH

SEQ ID NO: 114839 - protein, 9 aa, Homo sapiens
  light chain complementarity determining region 3 for antibody 57420
LQHNSYPYT

SEQ ID NO: 114840 - protein, 12 aa, Homo sapiens
  heavy chain complementarity determining region 3 for antibody 57420
AKDRSSYYGMDV

SEQ ID NO: 114841 - protein, 9 aa, Homo sapiens
  light chain complementarity determining region 3 for antibody 57421
LQHNGYPYT

SEQ ID NO: 114842 - protein, 14 aa, Homo sapiens
  heavy chain complementarity determining region 3 for antibody 57421
ARDGIFRYFDWFDY

SEQ ID NO: 114843 - protein, 9 aa, Homo sapiens
  light chain complementarity determining region 3 for antibody 57422
LQHDDFPYT

SEQ ID NO: 114844 - protein, 21 aa, Homo sapiens
  heavy chain complementarity determining region 3 for antibody 57422
AREGAYDILTGYSDYYYGMDV

SEQ ID NO: 114845 - protein, 9 aa, Homo sapiens
  light chain complementarity determining region 3 for antibody 57423
LQDYNYPWT

SEQ ID NO: 114846 - protein, 19 aa, Homo sapiens
  heavy chain complementarity determining region 3 for antibody 57423
ARSPPLFSSSWPEDYGMDV

SEQ ID NO: 114847 - protein, 9 aa, Homo sapiens
  light chain complementarity determining region 3 for antibody 57424
LQDYNYPWT

SEQ ID NO: 114848 - protein, 14 aa, Homo sapiens
  heavy chain complementarity determining region 3 for antibody 57424
ARDGYSSGWYGMDV

SEQ ID NO: 114849 - protein, 9 aa, Homo sapiens
  light chain complementarity determining region 3 for antibody 57425
LQDYNYPWT

SEQ ID NO: 114850 - protein, 19 aa, Homo sapiens
  heavy chain complementarity determining region 3 for antibody 57425
ARAPHIVATINYYYYGMDV

SEQ ID NO: 114851 - protein, 9 aa, Homo sapiens
  light chain complementarity determining region 3 for antibody 57426
LQDYNYPLT

SEQ ID NO: 114852 - protein, 10 aa, Homo sapiens
  heavy chain complementarity determining region 3 for antibody 57426
VRTTTVIFDY

SEQ ID NO: 114853 - protein, 9 aa, Homo sapiens
  light chain complementarity determining region 3 for antibody 57427
LQDYDYPHT

SEQ ID NO: 114854 - protein, 14 aa, Homo sapiens
  heavy chain complementarity determining region 3 for antibody 57427
VRDGGATHYNGMDV

SEQ ID NO: 114855 - protein, 9 aa, Homo sapiens
  light chain complementarity determining region 3 for antibody 57428
HQRSSLPHT

SEQ ID NO: 114856 - protein, 13 aa, Homo sapiens
  heavy chain complementarity determining region 3 for antibody 57428
ARGGYYGSGSLDY

SEQ ID NO: 114857 - protein, 9 aa, Homo sapiens
  light chain complementarity determining region 3 for antibody 57429
QQYNSYPYT

SEQ ID NO: 114858 - protein, 11 aa, Homo sapiens
  heavy chain complementarity determining region 3 for antibody 57429
ASAQWELLLDY

SEQ ID NO: 114859 - protein, 9 aa, Homo sapiens
  light chain complementarity determining region 3 for antibody 57430
QQYNSYPYT

SEQ ID NO: 114860 - protein, 14 aa, Homo sapiens
  heavy chain complementarity determining region 3 for antibody 57430
ARDHIYGSGSYFDY

SEQ ID NO: 114861 - protein, 9 aa, Homo sapiens
  light chain complementarity determining region 3 for antibody 57431
QQYNSYPWT

SEQ ID NO: 114862 - protein, 9 aa, Homo sapiens
  heavy chain complementarity determining region 3 for antibody 57431
ARDLGGFDY

SEQ ID NO: 114863 - protein, 9 aa, Homo sapiens
  light chain complementarity determining region 3 for antibody 57432
QQYNSYPLT

SEQ ID NO: 114864 - protein, 18 aa, Homo sapiens
  heavy chain complementarity determining region 3 for antibody 57432
ANGGYYGSGSYYRDWFDP

SEQ ID NO: 114865 - protein, 10 aa, Homo sapiens
  light chain complementarity determining region 3 for antibody 57433
QQYNNWPPFT

SEQ ID NO: 114866 - protein, 10 aa, Homo sapiens
  heavy chain complementarity determining region 3 for antibody 57433
ARHPVAYFDF

SEQ ID NO: 114867 - protein, 9 aa, Homo sapiens
  light chain complementarity determining region 3 for antibody 57434
QQYGSSPWT

SEQ ID NO: 114868 - protein, 10 aa, Homo sapiens
  heavy chain complementarity determining region 3 for antibody 57434
ARGGNWNVDY

SEQ ID NO: 114869 - protein, 9 aa, Homo sapiens
  light chain complementarity determining region 3 for antibody 57435
QQYGSSPRT

SEQ ID NO: 114870 - protein, 14 aa, Homo sapiens
  heavy chain complementarity determining region 3 for antibody 57435
AKERFRYFDWFLDY

SEQ ID NO: 114871 - protein, 9 aa, Homo sapiens
  light chain complementarity determining region 3 for antibody 57436
QQSYSTPYT

SEQ ID NO: 114872 - protein, 18 aa, Homo sapiens
  heavy chain complementarity determining region 3 for antibody 57436
AREGPYYDILTGYFPLDY

SEQ ID NO: 114873 - protein, 9 aa, Homo sapiens
  light chain complementarity determining region 3 for antibody 57437
QQFHNCPYT

SEQ ID NO: 114874 - protein, 11 aa, Homo sapiens
  heavy chain complementarity determining region 3 for antibody 57437
ARDPRIYGMDV

SEQ ID NO: 114875 - protein, 9 aa, Homo sapiens
  light chain complementarity determining region 3 for antibody 57438
QKYNSAPWT

SEQ ID NO: 114876 - protein, 15 aa, Homo sapiens
  heavy chain complementarity determining region 3 for antibody 57438
EKAGDYYGSGSPFDY

SEQ ID NO: 114877 - protein, 9 aa, Homo sapiens
  light chain complementarity determining region 3 for antibody 57439
QKYNSAPWT

SEQ ID NO: 114878 - protein, 15 aa, Homo sapiens
  heavy chain complementarity determining region 3 for antibody 57439
ARAGDYYGSGSPFDY

SEQ ID NO: 114879 - protein, 9 aa, Homo sapiens
  light chain complementarity determining region 3 for antibody 57440
MQALQTPRT

SEQ ID NO: 114880 - protein, 10 aa, Homo sapiens
  heavy chain complementarity determining region 3 for antibody 57440
ARDRVGATGY

SEQ ID NO: 114881 - protein, 9 aa, Homo sapiens
  light chain complementarity determining region 3 for antibody 57441
LQHNSYPWT

SEQ ID NO: 114882 - protein, 14 aa, Homo sapiens
  heavy chain complementarity determining region 3 for antibody 57441
ARDNYYDSSGSWDY

SEQ ID NO: 114883 - protein, 9 aa, Homo sapiens
  light chain complementarity determining region 3 for antibody 57442
LQHNSYPRT

SEQ ID NO: 114884 - protein, 13 aa, Homo sapiens
  heavy chain complementarity determining region 3 for antibody 57442
ARGGGFEESPSDY

SEQ ID NO: 114885 - protein, 9 aa, Homo sapiens
  light chain complementarity determining region 3 for antibody 57443
HQSSSLPYT

SEQ ID NO: 114886 - protein, 11 aa, Homo sapiens
  heavy chain complementarity determining region 3 for antibody 57443
ARYNWNDYFDY

SEQ ID NO: 114887 - protein, 9 aa, Homo sapiens
  light chain complementarity determining region 3 for antibody 57444
HQSSSLPHT

SEQ ID NO: 114888 - protein, 13 aa, Homo sapiens
  heavy chain complementarity determining region 3 for antibody 57444
ARGGYYGSWSLDY

SEQ ID NO: 114889 - protein, 9 aa, Homo sapiens
  light chain complementarity determining region 3 for antibody 57445
HQSSSLPHT

SEQ ID NO: 114890 - protein, 13 aa, Homo sapiens
  heavy chain complementarity determining region 3 for antibody 57445
ARGGYYGPGSLDY

SEQ ID NO: 114891 - protein, 9 aa, Homo sapiens
  light chain complementarity determining region 3 for antibody 57446
HQSSSLPHT

SEQ ID NO: 114892 - protein, 13 aa, Homo sapiens
  heavy chain complementarity determining region 3 for antibody 57446
AGGGYYGSGGLDY

SEQ ID NO: 114893 - protein, 9 aa, Homo sapiens
  light chain complementarity determining region 3 for antibody 57447
QQYNSYPRT

SEQ ID NO: 114894 - protein, 9 aa, Homo sapiens
  heavy chain complementarity determining region 3 for antibody 57447
ARDREAFDI

SEQ ID NO: 114895 - protein, 9 aa, Homo sapiens
  light chain complementarity determining region 3 for antibody 57448
QQYNNRPLT

SEQ ID NO: 114896 - protein, 14 aa, Homo sapiens
  heavy chain complementarity determining region 3 for antibody 57448
ARGRRYFDGGGMDV

SEQ ID NO: 114897 - protein, 8 aa, Homo sapiens
  light chain complementarity determining region 3 for antibody 57449
QQRSNWWT

SEQ ID NO: 114898 - protein, 10 aa, Homo sapiens
  heavy chain complementarity determining region 3 for antibody 57449
AREPDYGMDV

SEQ ID NO: 114899 - protein, 9 aa, Homo sapiens
  light chain complementarity determining region 3 for antibody 57450
QQLNSYPRT

SEQ ID NO: 114900 - protein, 11 aa, Homo sapiens
  heavy chain complementarity determining region 3 for antibody 57450
ARDHYYYGMDV

SEQ ID NO: 114901 - protein, 9 aa, Homo sapiens
  light chain complementarity determining region 3 for antibody 57451
QQFYNYPHT

SEQ ID NO: 114902 - protein, 13 aa, Homo sapiens
  heavy chain complementarity determining region 3 for antibody 57451
GRFLEGIGGALDI

SEQ ID NO: 114903 - protein, 9 aa, Homo sapiens
  light chain complementarity determining region 3 for antibody 57452
QQFNKYPYT

SEQ ID NO: 114904 - protein, 14 aa, Homo sapiens
  heavy chain complementarity determining region 3 for antibody 57452
ARRFRISVAAPFDY

SEQ ID NO: 114905 - protein, 9 aa, Homo sapiens
  light chain complementarity determining region 3 for antibody 57453
LQHNSHPPT

SEQ ID NO: 114906 - protein, 19 aa, Homo sapiens
  heavy chain complementarity determining region 3 for antibody 57453
AREGVGIVGANYYYYGMDV

SEQ ID NO: 114907 - protein, 9 aa, Homo sapiens
  light chain complementarity determining region 3 for antibody 57454
LQDYNYPYT

SEQ ID NO: 114908 - protein, 16 aa, Homo sapiens
  heavy chain complementarity determining region 3 for antibody 57454
ARGSFGSGSSSRWFDP

SEQ ID NO: 114909 - protein, 9 aa, Homo sapiens
  light chain complementarity determining region 3 for antibody 57455
LQDYNYPYT

SEQ ID NO: 114910 - protein, 18 aa, Homo sapiens
  heavy chain complementarity determining region 3 for antibody 57455
AKRITMVRGVISYYGMDV

SEQ ID NO: 114911 - protein, 9 aa, Homo sapiens
  light chain complementarity determining region 3 for antibody 57456
LQDYNYPRT

SEQ ID NO: 114912 - protein, 19 aa, Homo sapiens
  heavy chain complementarity determining region 3 for antibody 57456
ARDTFLYYDILNYYYGMDV

SEQ ID NO: 114913 - protein, 9 aa, Homo sapiens
  light chain complementarity determining region 3 for antibody 57457
QQYGSSPWT

SEQ ID NO: 114914 - protein, 9 aa, Homo sapiens
  heavy chain complementarity determining region 3 for antibody 57457
ARSNWGFDY

SEQ ID NO: 114915 - protein, 9 aa, Homo sapiens
  light chain complementarity determining region 3 for antibody 57458
QQLNSYPYT

SEQ ID NO: 114916 - protein, 19 aa, Homo sapiens
  heavy chain complementarity determining region 3 for antibody 57458
ARSSYHYDSSGYRSSFFDY

SEQ ID NO: 114917 - protein, 9 aa, Homo sapiens
  light chain complementarity determining region 3 for antibody 57459
QQLNSYPWT

SEQ ID NO: 114918 - protein, 19 aa, Homo sapiens
  heavy chain complementarity determining region 3 for antibody 57459
ARGGSGYDTLTGYPYGMDV

SEQ ID NO: 114919 - protein, 9 aa, Homo sapiens
  light chain complementarity determining region 3 for antibody 57460
QQFNNYPRT

SEQ ID NO: 114920 - protein, 18 aa, Homo sapiens
  heavy chain complementarity determining region 3 for antibody 57460
ARGELLRYFDWLSSPFDY

SEQ ID NO: 114921 - protein, 9 aa, Homo sapiens
  light chain complementarity determining region 3 for antibody 57461
LQHNSQPYT

SEQ ID NO: 114922 - protein, 14 aa, Homo sapiens
  heavy chain complementarity determining region 3 for antibody 57461
ARDGIFRYFDWFDY

SEQ ID NO: 114923 - protein, 9 aa, Homo sapiens
  light chain complementarity determining region 3 for antibody 57462
LQDYNYPWT

SEQ ID NO: 114924 - protein, 18 aa, Homo sapiens
  heavy chain complementarity determining region 3 for antibody 57462
AKGVTMVRGVTAYYGLDV

SEQ ID NO: 114925 - protein, 9 aa, Homo sapiens
  light chain complementarity determining region 3 for antibody 57463
KKYNSAPWT

SEQ ID NO: 114926 - protein, 15 aa, Homo sapiens
  heavy chain complementarity determining region 3 for antibody 57463
AKAGDYYGSGSPFDY

SEQ ID NO: 114927 - protein, 9 aa, Homo sapiens
  light chain complementarity determining region 3 for antibody 57464
HQSSSLPLT

SEQ ID NO: 114928 - protein, 13 aa, Homo sapiens
  heavy chain complementarity determining region 3 for antibody 57464
ARGGYYGSGSIDY

SEQ ID NO: 114929 - protein, 9 aa, Homo sapiens
  light chain complementarity determining region 3 for antibody 57465
HQSSGLPHT

SEQ ID NO: 114930 - protein, 13 aa, Homo sapiens
  heavy chain complementarity determining region 3 for antibody 57465
ARGGYYGSGSLDY

SEQ ID NO: 114931 - protein, 9 aa, Homo sapiens
  light chain complementarity determining region 3 for antibody 57466
QQYGSSPYT

SEQ ID NO: 114932 - protein, 18 aa, Homo sapiens
  heavy chain complementarity determining region 3 for antibody 57466
AKGEPHRGYSYGYTYFDY

SEQ ID NO: 114933 - protein, 11 aa, Homo sapiens
  light chain complementarity determining region 3 for antibody 57467
QQSYSTPPEYT

SEQ ID NO: 114934 - protein, 18 aa, Homo sapiens
  heavy chain complementarity determining region 3 for antibody 57467
ARDVLRCFDWLSNSHFDY

SEQ ID NO: 114935 - protein, 7 aa, Homo sapiens
  light chain complementarity determining region 3 for antibody 57468
QQHNSYS

SEQ ID NO: 114936 - protein, 9 aa, Homo sapiens
  heavy chain complementarity determining region 3 for antibody 57468
ARDLGGIDY

SEQ ID NO: 114937 - protein, 9 aa, Homo sapiens
  light chain complementarity determining region 3 for antibody 57469
QQHGSSPRT

SEQ ID NO: 114938 - protein, 14 aa, Homo sapiens
  heavy chain complementarity determining region 3 for antibody 57469
AKERFRYFDWFLDY

SEQ ID NO: 114939 - protein, 8 aa, Homo sapiens
  light chain complementarity determining region 3 for antibody 57470
QQFNTYHT

SEQ ID NO: 114940 - protein, 12 aa, Homo sapiens
  heavy chain complementarity determining region 3 for antibody 57470
ARYYLYYYGMDV

SEQ ID NO: 114941 - protein, 8 aa, Homo sapiens
  light chain complementarity determining region 3 for antibody 57471
QQDYNLPT

SEQ ID NO: 114942 - protein, 15 aa, Homo sapiens
  heavy chain complementarity determining region 3 for antibody 57471
ARVYDILTGWGFFDY

SEQ ID NO: 114943 - protein, 9 aa, Homo sapiens
  light chain complementarity determining region 3 for antibody 57472
QQDYNLPFT

SEQ ID NO: 114944 - protein, 19 aa, Homo sapiens
  heavy chain complementarity determining region 3 for antibody 57472
TGGEQQLVLGYYYYFGMDV

SEQ ID NO: 114945 - protein, 9 aa, Homo sapiens
  light chain complementarity determining region 3 for antibody 57473
QKYNSAPWT

SEQ ID NO: 114946 - protein, 15 aa, Homo sapiens
  heavy chain complementarity determining region 3 for antibody 57473
AKAGDYYGSGSPIDY

SEQ ID NO: 114947 - protein, 9 aa, Homo sapiens
  light chain complementarity determining region 3 for antibody 57474
QKYNSAPWT

SEQ ID NO: 114948 - protein, 15 aa, Homo sapiens
  heavy chain complementarity determining region 3 for antibody 57474
AKAGDYYGSGSPFDS

SEQ ID NO: 114949 - protein, 9 aa, Homo sapiens
  light chain complementarity determining region 3 for antibody 57475
QKYNSAPWT

SEQ ID NO: 114950 - protein, 15 aa, Homo sapiens
  heavy chain complementarity determining region 3 for antibody 57475
AKAGDYYGSGSHFDY

SEQ ID NO: 114951 - protein, 9 aa, Homo sapiens
  light chain complementarity determining region 3 for antibody 57476
QKYNSAPFT

SEQ ID NO: 114952 - protein, 11 aa, Homo sapiens
  heavy chain complementarity determining region 3 for antibody 57476
ARSFGSYFLDY

SEQ ID NO: 114953 - protein, 9 aa, Homo sapiens
  light chain complementarity determining region 3 for antibody 57477
QKYDSAPWT

SEQ ID NO: 114954 - protein, 15 aa, Homo sapiens
  heavy chain complementarity determining region 3 for antibody 57477
AKAGDYYGSGSPFDY

SEQ ID NO: 114955 - protein, 9 aa, Homo sapiens
  light chain complementarity determining region 3 for antibody 57478
LQHNSYPFT

SEQ ID NO: 114956 - protein, 10 aa, Homo sapiens
  heavy chain complementarity determining region 3 for antibody 57478
ASDSSGWLDY

SEQ ID NO: 114957 - protein, 9 aa, Homo sapiens
  light chain complementarity determining region 3 for antibody 57479
LQDYNYPWT

SEQ ID NO: 114958 - protein, 11 aa, Homo sapiens
  heavy chain complementarity determining region 3 for antibody 57479
ATGSPLLWFED

SEQ ID NO: 114959 - protein, 9 aa, Homo sapiens
  light chain complementarity determining region 3 for antibody 57480
LQDYNYPWT

SEQ ID NO: 114960 - protein, 19 aa, Homo sapiens
  heavy chain complementarity determining region 3 for antibody 57480
ARDPYTYYYGSGSPGGMDV

SEQ ID NO: 114961 - protein, 9 aa, Homo sapiens
  light chain complementarity determining region 3 for antibody 57481
LQDFNSPYT

SEQ ID NO: 114962 - protein, 20 aa, Homo sapiens
  heavy chain complementarity determining region 3 for antibody 57481
ARDRDYYGSGSYNNYYGMDV

SEQ ID NO: 114963 - protein, 9 aa, Homo sapiens
  light chain complementarity determining region 3 for antibody 57482
HQSSSLPYT

SEQ ID NO: 114964 - protein, 16 aa, Homo sapiens
  heavy chain complementarity determining region 3 for antibody 57482
ARTGYDILTGYDWLDP

SEQ ID NO: 114965 - protein, 9 aa, Homo sapiens
  light chain complementarity determining region 3 for antibody 57483
HQSSSLPHT

SEQ ID NO: 114966 - protein, 13 aa, Homo sapiens
  heavy chain complementarity determining region 3 for antibody 57483
ARGIAAAGSYFDY

SEQ ID NO: 114967 - protein, 8 aa, Homo sapiens
  light chain complementarity determining region 3 for antibody 57484
HQDYNLFT

SEQ ID NO: 114968 - protein, 14 aa, Homo sapiens
  heavy chain complementarity determining region 3 for antibody 57484
ARRTMVRGASYYDS

SEQ ID NO: 114969 - protein, 9 aa, Homo sapiens
  light chain complementarity determining region 3 for antibody 57485
QQYYSYPLT

SEQ ID NO: 114970 - protein, 13 aa, Homo sapiens
  heavy chain complementarity determining region 3 for antibody 57485
ARQKVGGPYYFDY

SEQ ID NO: 114971 - protein, 9 aa, Homo sapiens
  light chain complementarity determining region 3 for antibody 57486
QQYNSYPRT

SEQ ID NO: 114972 - protein, 21 aa, Homo sapiens
  heavy chain complementarity determining region 3 for antibody 57486
ARETDYDILTGPYYNYYAMDV

SEQ ID NO: 114973 - protein, 9 aa, Homo sapiens
  light chain complementarity determining region 3 for antibody 57487
QQSYSTPYT

SEQ ID NO: 114974 - protein, 15 aa, Homo sapiens
  heavy chain complementarity determining region 3 for antibody 57487
ARVSWFGEWGDAFDI

SEQ ID NO: 114975 - protein, 9 aa, Homo sapiens
  light chain complementarity determining region 3 for antibody 57488
QQRSNWPPT

SEQ ID NO: 114976 - protein, 13 aa, Homo sapiens
  heavy chain complementarity determining region 3 for antibody 57488
AREGGLAVAGIDY

SEQ ID NO: 114977 - protein, 9 aa, Homo sapiens
  light chain complementarity determining region 3 for antibody 57489
QQLNSYPLT

SEQ ID NO: 114978 - protein, 12 aa, Homo sapiens
  heavy chain complementarity determining region 3 for antibody 57489
ARMVRGAIPFDY

SEQ ID NO: 114979 - protein, 9 aa, Homo sapiens
  light chain complementarity determining region 3 for antibody 57490
QQFYNYPYT

SEQ ID NO: 114980 - protein, 11 aa, Homo sapiens
  heavy chain complementarity determining region 3 for antibody 57490
ARDPRISGFDH

SEQ ID NO: 114981 - protein, 7 aa, Homo sapiens
  light chain complementarity determining region 3 for antibody 57491
QQFNNYT

SEQ ID NO: 114982 - protein, 22 aa, Homo sapiens
  heavy chain complementarity determining region 3 for antibody 57491
ARGGIRYFDWGYMGNYYYGMDV

SEQ ID NO: 114983 - protein, 9 aa, Homo sapiens
  light chain complementarity determining region 3 for antibody 57492
QQFNNYPRT

SEQ ID NO: 114984 - protein, 11 aa, Homo sapiens
  heavy chain complementarity determining region 3 for antibody 57492
ARKIVGAHFDY

SEQ ID NO: 114985 - protein, 9 aa, Homo sapiens
  light chain complementarity determining region 3 for antibody 57493
QQFGSSPWT

SEQ ID NO: 114986 - protein, 10 aa, Homo sapiens
  heavy chain complementarity determining region 3 for antibody 57493
ARGVRGVKAY

SEQ ID NO: 114987 - protein, 9 aa, Homo sapiens
  light chain complementarity determining region 3 for antibody 57494
QKYYSAPWT

SEQ ID NO: 114988 - protein, 15 aa, Homo sapiens
  heavy chain complementarity determining region 3 for antibody 57494
AKAGDYYGSGSPFDY

SEQ ID NO: 114989 - protein, 9 aa, Homo sapiens
  light chain complementarity determining region 3 for antibody 57495
QKYNSAPWT

SEQ ID NO: 114990 - protein, 15 aa, Homo sapiens
  heavy chain complementarity determining region 3 for antibody 57495
AKAGAYYGSGSPFDY

SEQ ID NO: 114991 - protein, 9 aa, Homo sapiens
  light chain complementarity determining region 3 for antibody 57496
MQALQTPLT

SEQ ID NO: 114992 - protein, 10 aa, Homo sapiens
  heavy chain complementarity determining region 3 for antibody 57496
ARDRVGATRF

SEQ ID NO: 114993 - protein, 9 aa, Homo sapiens
  light chain complementarity determining region 3 for antibody 57497
LQHNSYPRT

SEQ ID NO: 114994 - protein, 13 aa, Homo sapiens
  heavy chain complementarity determining region 3 for antibody 57497
AREYCSSNSCYDH

SEQ ID NO: 114995 - protein, 9 aa, Homo sapiens
  light chain complementarity determining region 3 for antibody 57498
LQHNSYPLT

SEQ ID NO: 114996 - protein, 14 aa, Homo sapiens
  heavy chain complementarity determining region 3 for antibody 57498
ATGGASYYYYGMDV

SEQ ID NO: 114997 - protein, 9 aa, Homo sapiens
  light chain complementarity determining region 3 for antibody 57499
LQHDSYPWT

SEQ ID NO: 114998 - protein, 12 aa, Homo sapiens
  heavy chain complementarity determining region 3 for antibody 57499
ARGYSGYDSFDY

SEQ ID NO: 114999 - protein, 9 aa, Homo sapiens
  light chain complementarity determining region 3 for antibody 57500
LQHDNFPYT

SEQ ID NO: 115000 - protein, 18 aa, Homo sapiens
  heavy chain complementarity determining region 3 for antibody 57500
ARDGGITMVQGILRGMDV

SEQ ID NO: 115001 - protein, 9 aa, Homo sapiens
  light chain complementarity determining region 3 for antibody 57501
HQSSSLPWT

SEQ ID NO: 115002 - protein, 14 aa, Homo sapiens
  heavy chain complementarity determining region 3 for antibody 57501
AKAGSFYYYYGMDV

SEQ ID NO: 115003 - protein, 9 aa, Homo sapiens
  light chain complementarity determining region 3 for antibody 57502
HQSSSLPHT

SEQ ID NO: 115004 - protein, 13 aa, Homo sapiens
  heavy chain complementarity determining region 3 for antibody 57502
ARGGYYGSGSFDY

SEQ ID NO: 115005 - protein, 9 aa, Homo sapiens
  light chain complementarity determining region 3 for antibody 57503
HQSSSLPFT

SEQ ID NO: 115006 - protein, 6 aa, Homo sapiens
  heavy chain complementarity determining region 3 for antibody 57503
AREMDY

SEQ ID NO: 115007 - protein, 9 aa, Homo sapiens
  light chain complementarity determining region 3 for antibody 57504
QQYNSYPYT

SEQ ID NO: 115008 - protein, 14 aa, Homo sapiens
  heavy chain complementarity determining region 3 for antibody 57504
ASSDYYGSGTFFDF

SEQ ID NO: 115009 - protein, 9 aa, Homo sapiens
  light chain complementarity determining region 3 for antibody 57505
QQYNNWPLT

SEQ ID NO: 115010 - protein, 14 aa, Homo sapiens
  heavy chain complementarity determining region 3 for antibody 57505
ARGRRYFDGGGMDV

SEQ ID NO: 115011 - protein, 9 aa, Homo sapiens
  light chain complementarity determining region 3 for antibody 57506
QQSYSTPYT

SEQ ID NO: 115012 - protein, 13 aa, Homo sapiens
  heavy chain complementarity determining region 3 for antibody 57506
ARDQDYGSGSPDY

SEQ ID NO: 115013 - protein, 8 aa, Homo sapiens
  light chain complementarity determining region 3 for antibody 57507
QQSGSSFT

SEQ ID NO: 115014 - protein, 11 aa, Homo sapiens
  heavy chain complementarity determining region 3 for antibody 57507
ARGYYSAWVDV

SEQ ID NO: 115015 - protein, 9 aa, Homo sapiens
  light chain complementarity determining region 3 for antibody 57508
QQLNCYPYT

SEQ ID NO: 115016 - protein, 14 aa, Homo sapiens
  heavy chain complementarity determining region 3 for antibody 57508
ASPRRYFDWLSFDY

SEQ ID NO: 115017 - protein, 9 aa, Homo sapiens
  light chain complementarity determining region 3 for antibody 57509
QQFYNYPYT

SEQ ID NO: 115018 - protein, 11 aa, Homo sapiens
  heavy chain complementarity determining region 3 for antibody 57509
ARDPRISGFDC

SEQ ID NO: 115019 - protein, 9 aa, Homo sapiens
  light chain complementarity determining region 3 for antibody 57510
QQFNNYPLT

SEQ ID NO: 115020 - protein, 14 aa, Homo sapiens
  heavy chain complementarity determining region 3 for antibody 57510
ARDGFDWLLRAFDI

SEQ ID NO: 115021 - protein, 9 aa, Homo sapiens
  light chain complementarity determining region 3 for antibody 57511
QQCYSTPRT

SEQ ID NO: 115022 - protein, 20 aa, Homo sapiens
  heavy chain complementarity determining region 3 for antibody 57511
ARDAGLWFVDPYYYYNGMDV

SEQ ID NO: 115023 - protein, 9 aa, Homo sapiens
  light chain complementarity determining region 3 for antibody 57512
QLYNSYSRT

SEQ ID NO: 115024 - protein, 19 aa, Homo sapiens
  heavy chain complementarity determining region 3 for antibody 57512
AREPIATIGTEYYYYGMDV

SEQ ID NO: 115025 - protein, 9 aa, Homo sapiens
  light chain complementarity determining region 3 for antibody 57513
QKYNSAPWT

SEQ ID NO: 115026 - protein, 15 aa, Homo sapiens
  heavy chain complementarity determining region 3 for antibody 57513
AKARDYYGSGSPFDY

SEQ ID NO: 115027 - protein, 9 aa, Homo sapiens
  light chain complementarity determining region 3 for antibody 57514
LQHNTYPYT

SEQ ID NO: 115028 - protein, 18 aa, Homo sapiens
  heavy chain complementarity determining region 3 for antibody 57514
ARESSGGGGYYYYYDMDV

SEQ ID NO: 115029 - protein, 9 aa, Homo sapiens
  light chain complementarity determining region 3 for antibody 57515
LQHNSYPFT

SEQ ID NO: 115030 - protein, 10 aa, Homo sapiens
  heavy chain complementarity determining region 3 for antibody 57515
ARASSGWLDY

SEQ ID NO: 115031 - protein, 9 aa, Homo sapiens
  light chain complementarity determining region 3 for antibody 57516
LQHDNFPYT

SEQ ID NO: 115032 - protein, 18 aa, Homo sapiens
  heavy chain complementarity determining region 3 for antibody 57516
ARDGGIAMVRGILRGMDV

SEQ ID NO: 115033 - protein, 9 aa, Homo sapiens
  light chain complementarity determining region 3 for antibody 57517
LQDYNYPWT

SEQ ID NO: 115034 - protein, 11 aa, Homo sapiens
  heavy chain complementarity determining region 3 for antibody 57517
ATGSPLLCFGD

SEQ ID NO: 115035 - protein, 9 aa, Homo sapiens
  light chain complementarity determining region 3 for antibody 57518
LQDYNYPWT

SEQ ID NO: 115036 - protein, 13 aa, Homo sapiens
  heavy chain complementarity determining region 3 for antibody 57518
ARDHYYDSNGYDY

SEQ ID NO: 115037 - protein, 9 aa, Homo sapiens
  light chain complementarity determining region 3 for antibody 57519
LQDYNYPRT

SEQ ID NO: 115038 - protein, 15 aa, Homo sapiens
  heavy chain complementarity determining region 3 for antibody 57519
AREDAMIRAKWGFDH

SEQ ID NO: 115039 - protein, 9 aa, Homo sapiens
  light chain complementarity determining region 3 for antibody 57520
HQSSSLPHT

SEQ ID NO: 115040 - protein, 13 aa, Homo sapiens
  heavy chain complementarity determining region 3 for antibody 57520
ARGGYYGSGSLDD

SEQ ID NO: 115041 - protein, 9 aa, Homo sapiens
  light chain complementarity determining region 3 for antibody 57521
HQSSSLPHT

SEQ ID NO: 115042 - protein, 13 aa, Homo sapiens
  heavy chain complementarity determining region 3 for antibody 57521
ARGGYYGAGSLDY

SEQ ID NO: 115043 - protein, 9 aa, Homo sapiens
  light chain complementarity determining region 3 for antibody 57522
HQSSSLPHT

SEQ ID NO: 115044 - protein, 13 aa, Homo sapiens
  heavy chain complementarity determining region 3 for antibody 57522
ARGGYHGSGSLDY

SEQ ID NO: 115045 - protein, 9 aa, Homo sapiens
  light chain complementarity determining region 3 for antibody 57523
HQSSSLPHT

SEQ ID NO: 115046 - protein, 13 aa, Homo sapiens
  heavy chain complementarity determining region 3 for antibody 57523
ARGGFYGSGSLDY

SEQ ID NO: 115047 - protein, 9 aa, Homo sapiens
  light chain complementarity determining region 3 for antibody 57524
QQYNSYPPT

SEQ ID NO: 115048 - protein, 14 aa, Homo sapiens
  heavy chain complementarity determining region 3 for antibody 57524
ARDHSGSYFNCFDP

SEQ ID NO: 115049 - protein, 9 aa, Homo sapiens
  light chain complementarity determining region 3 for antibody 57525
QQYDSYPLT

SEQ ID NO: 115050 - protein, 14 aa, Homo sapiens
  heavy chain complementarity determining region 3 for antibody 57525
ARDRYGGNLNWFDS

SEQ ID NO: 115051 - protein, 9 aa, Homo sapiens
  light chain complementarity determining region 3 for antibody 57526
QQVYNYPHT

SEQ ID NO: 115052 - protein, 13 aa, Homo sapiens
  heavy chain complementarity determining region 3 for antibody 57526
GRFLEGIGGAFDI

SEQ ID NO: 115053 - protein, 9 aa, Homo sapiens
  light chain complementarity determining region 3 for antibody 57527
QQSYSTPLT

SEQ ID NO: 115054 - protein, 12 aa, Homo sapiens
  heavy chain complementarity determining region 3 for antibody 57527
AREGGNDDAFDI

SEQ ID NO: 115055 - protein, 9 aa, Homo sapiens
  light chain complementarity determining region 3 for antibody 57528
QQLNSYPRT

SEQ ID NO: 115056 - protein, 11 aa, Homo sapiens
  heavy chain complementarity determining region 3 for antibody 57528
ARDRMYYGMDV

SEQ ID NO: 115057 - protein, 9 aa, Homo sapiens
  light chain complementarity determining region 3 for antibody 57529
QQLNSYPRT

SEQ ID NO: 115058 - protein, 11 aa, Homo sapiens
  heavy chain complementarity determining region 3 for antibody 57529
ARDPRYYGMDV

SEQ ID NO: 115059 - protein, 9 aa, Homo sapiens
  light chain complementarity determining region 3 for antibody 57530
QQLNSYPPT

SEQ ID NO: 115060 - protein, 17 aa, Homo sapiens
  heavy chain complementarity determining region 3 for antibody 57530
ARDPLYYYDAGSSGMDV

SEQ ID NO: 115061 - protein, 9 aa, Homo sapiens
  light chain complementarity determining region 3 for antibody 57531
QQLNSYPPT

SEQ ID NO: 115062 - protein, 11 aa, Homo sapiens
  heavy chain complementarity determining region 3 for antibody 57531
ARAERGGSFDY

SEQ ID NO: 115063 - protein, 9 aa, Homo sapiens
  light chain complementarity determining region 3 for antibody 57532
QQLNSYPLT

SEQ ID NO: 115064 - protein, 12 aa, Homo sapiens
  heavy chain complementarity determining region 3 for antibody 57532
ARMVRGVNPFDY

SEQ ID NO: 115065 - protein, 9 aa, Homo sapiens
  light chain complementarity determining region 3 for antibody 57533
QQLNSYPLT

SEQ ID NO: 115066 - protein, 15 aa, Homo sapiens
  heavy chain complementarity determining region 3 for antibody 57533
ARGAIIDWLLYYFDY

SEQ ID NO: 115067 - protein, 9 aa, Homo sapiens
  light chain complementarity determining region 3 for antibody 57534
QQFNNYPYT

SEQ ID NO: 115068 - protein, 17 aa, Homo sapiens
  heavy chain complementarity determining region 3 for antibody 57534
AREGYYYGSGSYYPFDY

SEQ ID NO: 115069 - protein, 9 aa, Homo sapiens
  light chain complementarity determining region 3 for antibody 57535
QKYNSVPWT

SEQ ID NO: 115070 - protein, 15 aa, Homo sapiens
  heavy chain complementarity determining region 3 for antibody 57535
AKAGDYYGSGSPFDY

SEQ ID NO: 115071 - protein, 9 aa, Homo sapiens
  light chain complementarity determining region 3 for antibody 57536
LRHNSYPRT

SEQ ID NO: 115072 - protein, 13 aa, Homo sapiens
  heavy chain complementarity determining region 3 for antibody 57536
AREYCSSTSCYDY

SEQ ID NO: 115073 - protein, 9 aa, Homo sapiens
  light chain complementarity determining region 3 for antibody 57537
LQHNSYPYT

SEQ ID NO: 115074 - protein, 12 aa, Homo sapiens
  heavy chain complementarity determining region 3 for antibody 57537
AKDRSFYYGMDV

SEQ ID NO: 115075 - protein, 9 aa, Homo sapiens
  light chain complementarity determining region 3 for antibody 57538
LQHNSYPYT

SEQ ID NO: 115076 - protein, 12 aa, Homo sapiens
  heavy chain complementarity determining region 3 for antibody 57538
AKDRSDYYGMDV

SEQ ID NO: 115077 - protein, 9 aa, Homo sapiens
  light chain complementarity determining region 3 for antibody 57539
LQHNSYPRT

SEQ ID NO: 115078 - protein, 18 aa, Homo sapiens
  heavy chain complementarity determining region 3 for antibody 57539
AAPITGTTGYYYYYGMDV

SEQ ID NO: 115079 - protein, 9 aa, Homo sapiens
  light chain complementarity determining region 3 for antibody 57540
LQHNSYPFT

SEQ ID NO: 115080 - protein, 10 aa, Homo sapiens
  heavy chain complementarity determining region 3 for antibody 57540
AGDSSGWLDY

SEQ ID NO: 115081 - protein, 9 aa, Homo sapiens
  light chain complementarity determining region 3 for antibody 57541
LQDYSYPWT

SEQ ID NO: 115082 - protein, 11 aa, Homo sapiens
  heavy chain complementarity determining region 3 for antibody 57541
ATGSPLLWFGD

SEQ ID NO: 115083 - protein, 9 aa, Homo sapiens
  light chain complementarity determining region 3 for antibody 57542
LQDYNYPYT

SEQ ID NO: 115084 - protein, 15 aa, Homo sapiens
  heavy chain complementarity determining region 3 for antibody 57542
ARNRNTAMAPDAFDI

SEQ ID NO: 115085 - protein, 9 aa, Homo sapiens
  light chain complementarity determining region 3 for antibody 57543
LQDYNYPWT

SEQ ID NO: 115086 - protein, 17 aa, Homo sapiens
  heavy chain complementarity determining region 3 for antibody 57543
ARGEGKLRYFDWLLGDY

SEQ ID NO: 115087 - protein, 9 aa, Homo sapiens
  light chain complementarity determining region 3 for antibody 57544
LQDYNYPRT

SEQ ID NO: 115088 - protein, 15 aa, Homo sapiens
  heavy chain complementarity determining region 3 for antibody 57544
ARDPAMVRGVIPFDY

SEQ ID NO: 115089 - protein, 9 aa, Homo sapiens
  light chain complementarity determining region 3 for antibody 57545
LQDYNYPRT

SEQ ID NO: 115090 - protein, 18 aa, Homo sapiens
  heavy chain complementarity determining region 3 for antibody 57545
AKDRLAYCGGDCYSNFDY

SEQ ID NO: 115091 - protein, 9 aa, Homo sapiens
  light chain complementarity determining region 3 for antibody 57546
HQTSSLPLT

SEQ ID NO: 115092 - protein, 15 aa, Homo sapiens
  heavy chain complementarity determining region 3 for antibody 57546
AREETPYSSGWSFDY

SEQ ID NO: 115093 - protein, 9 aa, Homo sapiens
  light chain complementarity determining region 3 for antibody 57547
HQSSSLPYT

SEQ ID NO: 115094 - protein, 7 aa, Homo sapiens
  heavy chain complementarity determining region 3 for antibody 57547
ARSPIFY

SEQ ID NO: 115095 - protein, 9 aa, Homo sapiens
  light chain complementarity determining region 3 for antibody 57548
HQSSSLPWT

SEQ ID NO: 115096 - protein, 12 aa, Homo sapiens
  heavy chain complementarity determining region 3 for antibody 57548
ARDERFGESFDY

SEQ ID NO: 115097 - protein, 9 aa, Homo sapiens
  light chain complementarity determining region 3 for antibody 57549
HQSSSLPRT

SEQ ID NO: 115098 - protein, 13 aa, Homo sapiens
  heavy chain complementarity determining region 3 for antibody 57549
ARGGYYGSGSLDY

SEQ ID NO: 115099 - protein, 9 aa, Homo sapiens
  light chain complementarity determining region 3 for antibody 57550
HQSSSLPHT

SEQ ID NO: 115100 - protein, 12 aa, Homo sapiens
  heavy chain complementarity determining region 3 for antibody 57550
ARDNDILTGLDL

SEQ ID NO: 115101 - protein, 9 aa, Homo sapiens
  light chain complementarity determining region 3 for antibody 57551
QQYNSYPRT

SEQ ID NO: 115102 - protein, 21 aa, Homo sapiens
  heavy chain complementarity determining region 3 for antibody 57551
ARGTDYDILTGPYYNYYTMDV

SEQ ID NO: 115103 - protein, 11 aa, Homo sapiens
  light chain complementarity determining region 3 for antibody 57552
QQYNNWPPMYT

SEQ ID NO: 115104 - protein, 19 aa, Homo sapiens
  heavy chain complementarity determining region 3 for antibody 57552
ARGPLYDILTGYYYHGLDV

SEQ ID NO: 115105 - protein, 9 aa, Homo sapiens
  light chain complementarity determining region 3 for antibody 57553
QQYGSSPLT

SEQ ID NO: 115106 - protein, 17 aa, Homo sapiens
  heavy chain complementarity determining region 3 for antibody 57553
AREGYYYGSGSYEVFDY

SEQ ID NO: 115107 - protein, 9 aa, Homo sapiens
  light chain complementarity determining region 3 for antibody 57554
QQSFSTPFT

SEQ ID NO: 115108 - protein, 17 aa, Homo sapiens
  heavy chain complementarity determining region 3 for antibody 57554
ARAESYWDYSYYYGMDV

SEQ ID NO: 115109 - protein, 10 aa, Homo sapiens
  light chain complementarity determining region 3 for antibody 57555
QQRSNWPPFT

SEQ ID NO: 115110 - protein, 18 aa, Homo sapiens
  heavy chain complementarity determining region 3 for antibody 57555
ARDPYDILTGYHSYGMDV

SEQ ID NO: 115111 - protein, 9 aa, Homo sapiens
  light chain complementarity determining region 3 for antibody 57556
QQLNSYPWT

SEQ ID NO: 115112 - protein, 17 aa, Homo sapiens
  heavy chain complementarity determining region 3 for antibody 57556
AGGYGSGSYYNYYGMDV

SEQ ID NO: 115113 - protein, 9 aa, Homo sapiens
  light chain complementarity determining region 3 for antibody 57557
QQLNSYPRT

SEQ ID NO: 115114 - protein, 11 aa, Homo sapiens
  heavy chain complementarity determining region 3 for antibody 57557
AREHYSYGMDV

SEQ ID NO: 115115 - protein, 9 aa, Homo sapiens
  light chain complementarity determining region 3 for antibody 57558
QQLNSYPLT

SEQ ID NO: 115116 - protein, 15 aa, Homo sapiens
  heavy chain complementarity determining region 3 for antibody 57558
ARDGGYSGYPSGMDV

SEQ ID NO: 115117 - protein, 9 aa, Homo sapiens
  light chain complementarity determining region 3 for antibody 57559
QQFNSYQWT

SEQ ID NO: 115118 - protein, 13 aa, Homo sapiens
  heavy chain complementarity determining region 3 for antibody 57559
ARITMVRGVSFDY

SEQ ID NO: 115119 - protein, 9 aa, Homo sapiens
  light chain complementarity determining region 3 for antibody 57560
QQFNNYTYT

SEQ ID NO: 115120 - protein, 14 aa, Homo sapiens
  heavy chain complementarity determining region 3 for antibody 57560
ARRFRIAVAAPFDY

SEQ ID NO: 115121 - protein, 9 aa, Homo sapiens
  light chain complementarity determining region 3 for antibody 57561
QQCYSTPRT

SEQ ID NO: 115122 - protein, 20 aa, Homo sapiens
  heavy chain complementarity determining region 3 for antibody 57561
ARDAGVWFVDPCYYYNGMDV

SEQ ID NO: 115123 - protein, 9 aa, Homo sapiens
  light chain complementarity determining region 3 for antibody 57562
QKYNSAPWT

SEQ ID NO: 115124 - protein, 15 aa, Homo sapiens
  heavy chain complementarity determining region 3 for antibody 57562
AKAGDYYGSGSTFDY

SEQ ID NO: 115125 - protein, 8 aa, Homo sapiens
  light chain complementarity determining region 3 for antibody 57563
QHDYNLPT

SEQ ID NO: 115126 - protein, 15 aa, Homo sapiens
  heavy chain complementarity determining region 3 for antibody 57563
ARVYDILTGWGFFDY

SEQ ID NO: 115127 - protein, 9 aa, Homo sapiens
  light chain complementarity determining region 3 for antibody 57564
LQHNSYPYT

SEQ ID NO: 115128 - protein, 12 aa, Homo sapiens
  heavy chain complementarity determining region 3 for antibody 57564
AKDRSCYYGMDV

SEQ ID NO: 115129 - protein, 9 aa, Homo sapiens
  light chain complementarity determining region 3 for antibody 57565
LQHNSYPLT

SEQ ID NO: 115130 - protein, 15 aa, Homo sapiens
  heavy chain complementarity determining region 3 for antibody 57565
ARDDYDILTGYSFDY

SEQ ID NO: 115131 - protein, 9 aa, Homo sapiens
  light chain complementarity determining region 3 for antibody 57566
LQDYSYPWT

SEQ ID NO: 115132 - protein, 10 aa, Homo sapiens
  heavy chain complementarity determining region 3 for antibody 57566
ATMTNVTFNY

SEQ ID NO: 115133 - protein, 9 aa, Homo sapiens
  light chain complementarity determining region 3 for antibody 57567
LQDYSYPWT

SEQ ID NO: 115134 - protein, 10 aa, Homo sapiens
  heavy chain complementarity determining region 3 for antibody 57567
ATMTNVAFDY

SEQ ID NO: 115135 - protein, 9 aa, Homo sapiens
  light chain complementarity determining region 3 for antibody 57568
LQDYNYPYT

SEQ ID NO: 115136 - protein, 12 aa, Homo sapiens
  heavy chain complementarity determining region 3 for antibody 57568
ARMVREFFPFDY

SEQ ID NO: 115137 - protein, 9 aa, Homo sapiens
  light chain complementarity determining region 3 for antibody 57569
LQDYNYPYT

SEQ ID NO: 115138 - protein, 18 aa, Homo sapiens
  heavy chain complementarity determining region 3 for antibody 57569
ARGAWYYYGSGSYYAFDY

SEQ ID NO: 115139 - protein, 9 aa, Homo sapiens
  light chain complementarity determining region 3 for antibody 57570
LQDYNYPYT

SEQ ID NO: 115140 - protein, 21 aa, Homo sapiens
  heavy chain complementarity determining region 3 for antibody 57570
AREGAYDILTGYSDYYYGMDV

SEQ ID NO: 115141 - protein, 9 aa, Homo sapiens
  light chain complementarity determining region 3 for antibody 57571
LQDYNYPYT

SEQ ID NO: 115142 - protein, 21 aa, Homo sapiens
  heavy chain complementarity determining region 3 for antibody 57571
ARDGAYDILTGYSDYYYGMDV

SEQ ID NO: 115143 - protein, 9 aa, Homo sapiens
  light chain complementarity determining region 3 for antibody 57572
LQDYNYPWT

SEQ ID NO: 115144 - protein, 11 aa, Homo sapiens
  heavy chain complementarity determining region 3 for antibody 57572
ATGSPLLGFGD

SEQ ID NO: 115145 - protein, 9 aa, Homo sapiens
  light chain complementarity determining region 3 for antibody 57573
LQDYNYPWT

SEQ ID NO: 115146 - protein, 21 aa, Homo sapiens
  heavy chain complementarity determining region 3 for antibody 57573
ARQDYYYGSGSYYNVRYGMDV

SEQ ID NO: 115147 - protein, 9 aa, Homo sapiens
  light chain complementarity determining region 3 for antibody 57574
LQDYNYPWT

SEQ ID NO: 115148 - protein, 14 aa, Homo sapiens
  heavy chain complementarity determining region 3 for antibody 57574
AGRHYDSLTGFSDY

SEQ ID NO: 115149 - protein, 9 aa, Homo sapiens
  light chain complementarity determining region 3 for antibody 57575
LQDYNYPRT

SEQ ID NO: 115150 - protein, 17 aa, Homo sapiens
  heavy chain complementarity determining region 3 for antibody 57575
TTAPVGATLYYYYGMDV

SEQ ID NO: 115151 - protein, 9 aa, Homo sapiens
  light chain complementarity determining region 3 for antibody 57576
LQDYNYPFT

SEQ ID NO: 115152 - protein, 13 aa, Homo sapiens
  heavy chain complementarity determining region 3 for antibody 57576
ARDLTGTSNWFDH

SEQ ID NO: 115153 - protein, 9 aa, Homo sapiens
  light chain complementarity determining region 3 for antibody 57577
HQSTSLPYT

SEQ ID NO: 115154 - protein, 13 aa, Homo sapiens
  heavy chain complementarity determining region 3 for antibody 57577
ARHSGSYGRYFDY

SEQ ID NO: 115155 - protein, 9 aa, Homo sapiens
  light chain complementarity determining region 3 for antibody 57578
HQSSSLPYT

SEQ ID NO: 115156 - protein, 13 aa, Homo sapiens
  heavy chain complementarity determining region 3 for antibody 57578
ARHSGSYGRYFGY

SEQ ID NO: 115157 - protein, 10 aa, Homo sapiens
  light chain complementarity determining region 3 for antibody 57579
HQSSSLPMYT

SEQ ID NO: 115158 - protein, 5 aa, Homo sapiens
  heavy chain complementarity determining region 3 for antibody 57579
ADLGY

SEQ ID NO: 115159 - protein, 9 aa, Homo sapiens
  light chain complementarity determining region 3 for antibody 57580
HQSSSLPLT

SEQ ID NO: 115160 - protein, 13 aa, Homo sapiens
  heavy chain complementarity determining region 3 for antibody 57580
ALNYGDYGDWFDP

SEQ ID NO: 115161 - protein, 9 aa, Homo sapiens
  light chain complementarity determining region 3 for antibody 57581
HQSSSLPHT

SEQ ID NO: 115162 - protein, 5 aa, Homo sapiens
  heavy chain complementarity determining region 3 for antibody 57581
ADLGY

SEQ ID NO: 115163 - protein, 9 aa, Homo sapiens
  light chain complementarity determining region 3 for antibody 57582
QQYYSYPYT

SEQ ID NO: 115164 - protein, 16 aa, Homo sapiens
  heavy chain complementarity determining region 3 for antibody 57582
TTGVAGPKHYYYGLDV

SEQ ID NO: 115165 - protein, 9 aa, Homo sapiens
  light chain complementarity determining region 3 for antibody 57583
QQYNSYPYT

SEQ ID NO: 115166 - protein, 16 aa, Homo sapiens
  heavy chain complementarity determining region 3 for antibody 57583
TRDDNWDHYYYYGMDV

SEQ ID NO: 115167 - protein, 9 aa, Homo sapiens
  light chain complementarity determining region 3 for antibody 57584
QQYNSYPPT

SEQ ID NO: 115168 - protein, 11 aa, Homo sapiens
  heavy chain complementarity determining region 3 for antibody 57584
ARGRGAAAGDY

SEQ ID NO: 115169 - protein, 9 aa, Homo sapiens
  light chain complementarity determining region 3 for antibody 57585
QQYNNWPFT

SEQ ID NO: 115170 - protein, 12 aa, Homo sapiens
  heavy chain complementarity determining region 3 for antibody 57585
ARDRSSWSFFDY

SEQ ID NO: 115171 - protein, 9 aa, Homo sapiens
  light chain complementarity determining region 3 for antibody 57586
QQLNSYPRT

SEQ ID NO: 115172 - protein, 11 aa, Homo sapiens
  heavy chain complementarity determining region 3 for antibody 57586
ARDRRYYGIDV

SEQ ID NO: 115173 - protein, 9 aa, Homo sapiens
  light chain complementarity determining region 3 for antibody 57587
QQLNSYPPT

SEQ ID NO: 115174 - protein, 11 aa, Homo sapiens
  heavy chain complementarity determining region 3 for antibody 57587
AGAERGGYFDY

SEQ ID NO: 115175 - protein, 9 aa, Homo sapiens
  light chain complementarity determining region 3 for antibody 57588
QQLNSYPLT

SEQ ID NO: 115176 - protein, 12 aa, Homo sapiens
  heavy chain complementarity determining region 3 for antibody 57588
ARMGRGVIPFDY

SEQ ID NO: 115177 - protein, 9 aa, Homo sapiens
  light chain complementarity determining region 3 for antibody 57589
QQLNSYPLT

SEQ ID NO: 115178 - protein, 15 aa, Homo sapiens
  heavy chain complementarity determining region 3 for antibody 57589
ARDGGYSGYPIGKDV

SEQ ID NO: 115179 - protein, 9 aa, Homo sapiens
  light chain complementarity determining region 3 for antibody 57590
QQLNSYPFT

SEQ ID NO: 115180 - protein, 21 aa, Homo sapiens
  heavy chain complementarity determining region 3 for antibody 57590
ARVGTMVRGVITRYYYYGMDV

SEQ ID NO: 115181 - protein, 9 aa, Homo sapiens
  light chain complementarity determining region 3 for antibody 57591
QQLHSYPFT

SEQ ID NO: 115182 - protein, 15 aa, Homo sapiens
  heavy chain complementarity determining region 3 for antibody 57591
TRDDTGYYYYYGMDV

SEQ ID NO: 115183 - protein, 8 aa, Homo sapiens
  light chain complementarity determining region 3 for antibody 57592
QQDYNLFT

SEQ ID NO: 115184 - protein, 14 aa, Homo sapiens
  heavy chain complementarity determining region 3 for antibody 57592
AKQGSGKFGYGMDV

SEQ ID NO: 115185 - protein, 9 aa, Homo sapiens
  light chain complementarity determining region 3 for antibody 57593
QKYNSAPWT

SEQ ID NO: 115186 - protein, 15 aa, Homo sapiens
  heavy chain complementarity determining region 3 for antibody 57593
AKAGEYYGSGSPFDY

SEQ ID NO: 115187 - protein, 9 aa, Homo sapiens
  light chain complementarity determining region 3 for antibody 57594
QKYNSAPWT

SEQ ID NO: 115188 - protein, 6 aa, Homo sapiens
  heavy chain complementarity determining region 3 for antibody 57594
AKAGDY

SEQ ID NO: 115189 - protein, 9 aa, Homo sapiens
  light chain complementarity determining region 3 for antibody 57595
QKYNSAPWM

SEQ ID NO: 115190 - protein, 15 aa, Homo sapiens
  heavy chain complementarity determining region 3 for antibody 57595
AKAGDYYGSGSPFDY

SEQ ID NO: 115191 - protein, 9 aa, Homo sapiens
  light chain complementarity determining region 3 for antibody 57596
MQALQTPYT

SEQ ID NO: 115192 - protein, 18 aa, Homo sapiens
  heavy chain complementarity determining region 3 for antibody 57596
ARVGVGATTFYYYYGMDD

SEQ ID NO: 115193 - protein, 9 aa, Homo sapiens
  light chain complementarity determining region 3 for antibody 57597
MQALQTPIT

SEQ ID NO: 115194 - protein, 21 aa, Homo sapiens
  heavy chain complementarity determining region 3 for antibody 57597
ARDRGTMVRGVMVYYYYGMDV

SEQ ID NO: 115195 - protein, 9 aa, Homo sapiens
  light chain complementarity determining region 3 for antibody 57598
LQHNSYPYT

SEQ ID NO: 115196 - protein, 16 aa, Homo sapiens
  heavy chain complementarity determining region 3 for antibody 57598
TRDDNWDHYYYYGMDV

SEQ ID NO: 115197 - protein, 9 aa, Homo sapiens
  light chain complementarity determining region 3 for antibody 57599
LQHNSYPYT

SEQ ID NO: 115198 - protein, 18 aa, Homo sapiens
  heavy chain complementarity determining region 3 for antibody 57599
SPAGRDSGSYYYYYGMDV

SEQ ID NO: 115199 - protein, 9 aa, Homo sapiens
  light chain complementarity determining region 3 for antibody 57600
LQHNSYPFT

SEQ ID NO: 115200 - protein, 10 aa, Homo sapiens
  heavy chain complementarity determining region 3 for antibody 57600
ARDISGWLDY

SEQ ID NO: 115201 - protein, 9 aa, Homo sapiens
  light chain complementarity determining region 3 for antibody 57601
LQGYNYPWT

SEQ ID NO: 115202 - protein, 13 aa, Homo sapiens
  heavy chain complementarity determining region 3 for antibody 57601
AKVWSSGWSDFDY

SEQ ID NO: 115203 - protein, 9 aa, Homo sapiens
  light chain complementarity determining region 3 for antibody 57602
LQDYNYPYT

SEQ ID NO: 115204 - protein, 16 aa, Homo sapiens
  heavy chain complementarity determining region 3 for antibody 57602
ARGYFGSGSSSRWFDH

SEQ ID NO: 115205 - protein, 9 aa, Homo sapiens
  light chain complementarity determining region 3 for antibody 57603
LQDYNYPYT

SEQ ID NO: 115206 - protein, 16 aa, Homo sapiens
  heavy chain complementarity determining region 3 for antibody 57603
AGGYFGSGSSSRWFDP

SEQ ID NO: 115207 - protein, 9 aa, Homo sapiens
  light chain complementarity determining region 3 for antibody 57604
LQDYNYPWT

SEQ ID NO: 115208 - protein, 11 aa, Homo sapiens
  heavy chain complementarity determining region 3 for antibody 57604
ATGSPLLWFDD

SEQ ID NO: 115209 - protein, 9 aa, Homo sapiens
  light chain complementarity determining region 3 for antibody 57605
HQYNSYPFT

SEQ ID NO: 115210 - protein, 13 aa, Homo sapiens
  heavy chain complementarity determining region 3 for antibody 57605
ARERWAANPCFDY

SEQ ID NO: 115211 - protein, 9 aa, Homo sapiens
  light chain complementarity determining region 3 for antibody 57606
HQSSSLPHT

SEQ ID NO: 115212 - protein, 13 aa, Homo sapiens
  heavy chain complementarity determining region 3 for antibody 57606
ARGGYYGSGSPDY

SEQ ID NO: 115213 - protein, 9 aa, Homo sapiens
  light chain complementarity determining region 3 for antibody 57607
HQSSSLPHT

SEQ ID NO: 115214 - protein, 13 aa, Homo sapiens
  heavy chain complementarity determining region 3 for antibody 57607
ARGGYYGSGSLAY

SEQ ID NO: 115215 - protein, 9 aa, Homo sapiens
  light chain complementarity determining region 3 for antibody 57608
HQSSSLPHT

SEQ ID NO: 115216 - protein, 13 aa, Homo sapiens
  heavy chain complementarity determining region 3 for antibody 57608
ARAGYYGSGSLDY

SEQ ID NO: 115217 - protein, 9 aa, Homo sapiens
  light chain complementarity determining region 3 for antibody 57609
RQSSSLPHT

SEQ ID NO: 115218 - protein, 13 aa, Homo sapiens
  heavy chain complementarity determining region 3 for antibody 57609
ARGGYYGSGSLDY

SEQ ID NO: 115219 - protein, 9 aa, Homo sapiens
  light chain complementarity determining region 3 for antibody 57610
QQYNSYPYT

SEQ ID NO: 115220 - protein, 18 aa, Homo sapiens
  heavy chain complementarity determining region 3 for antibody 57610
ARDGHYYGSGSYEDWFDH

SEQ ID NO: 115221 - protein, 9 aa, Homo sapiens
  light chain complementarity determining region 3 for antibody 57611
QQYNNWPYT

SEQ ID NO: 115222 - protein, 17 aa, Homo sapiens
  heavy chain complementarity determining region 3 for antibody 57611
ARDITMVRGVKDYGMDV

SEQ ID NO: 115223 - protein, 9 aa, Homo sapiens
  light chain complementarity determining region 3 for antibody 57612
QQYGSSPYT

SEQ ID NO: 115224 - protein, 16 aa, Homo sapiens
  heavy chain complementarity determining region 3 for antibody 57612
ARSLLRYFDFMNYFDY

SEQ ID NO: 115225 - protein, 9 aa, Homo sapiens
  light chain complementarity determining region 3 for antibody 57613
QQYGSSPLT

SEQ ID NO: 115226 - protein, 9 aa, Homo sapiens
  heavy chain complementarity determining region 3 for antibody 57613
ASANWVFDY

SEQ ID NO: 115227 - protein, 9 aa, Homo sapiens
  light chain complementarity determining region 3 for antibody 57614
QQWTSNPLT

SEQ ID NO: 115228 - protein, 11 aa, Homo sapiens
  heavy chain complementarity determining region 3 for antibody 57614
IRDGNYEGFAY

SEQ ID NO: 115229 - protein, 8 aa, Homo sapiens
  light chain complementarity determining region 3 for antibody 57615
QQRSNWWT

SEQ ID NO: 115230 - protein, 10 aa, Homo sapiens
  heavy chain complementarity determining region 3 for antibody 57615
GRDGDYGMDV

SEQ ID NO: 115231 - protein, 9 aa, Homo sapiens
  light chain complementarity determining region 3 for antibody 57616
QQLNSYPLT

SEQ ID NO: 115232 - protein, 12 aa, Homo sapiens
  heavy chain complementarity determining region 3 for antibody 57616
AKMVRGVIPFDY

SEQ ID NO: 115233 - protein, 9 aa, Homo sapiens
  light chain complementarity determining region 3 for antibody 57617
QQLKSYPRT

SEQ ID NO: 115234 - protein, 11 aa, Homo sapiens
  heavy chain complementarity determining region 3 for antibody 57617
ARDRSYYGMDV

SEQ ID NO: 115235 - protein, 9 aa, Homo sapiens
  light chain complementarity determining region 3 for antibody 57618
QQLDSYPLT

SEQ ID NO: 115236 - protein, 12 aa, Homo sapiens
  heavy chain complementarity determining region 3 for antibody 57618
ARMVRGVIPFDY

SEQ ID NO: 115237 - protein, 9 aa, Homo sapiens
  light chain complementarity determining region 3 for antibody 57619
QQFYNYPHT

SEQ ID NO: 115238 - protein, 13 aa, Homo sapiens
  heavy chain complementarity determining region 3 for antibody 57619
GGFLEGIGGAFDI

SEQ ID NO: 115239 - protein, 9 aa, Homo sapiens
  light chain complementarity determining region 3 for antibody 57620
QQFHNYPYT

SEQ ID NO: 115240 - protein, 14 aa, Homo sapiens
  heavy chain complementarity determining region 3 for antibody 57620
ARGIELWLGNFFDC

SEQ ID NO: 115241 - protein, 8 aa, Homo sapiens
  light chain complementarity determining region 3 for antibody 57621
QQDYNLYT

SEQ ID NO: 115242 - protein, 17 aa, Homo sapiens
  heavy chain complementarity determining region 3 for antibody 57621
ARDWDYYGSGSYGVFDY

SEQ ID NO: 115243 - protein, 9 aa, Homo sapiens
  light chain complementarity determining region 3 for antibody 57622
QKYNSAPWT

SEQ ID NO: 115244 - protein, 15 aa, Homo sapiens
  heavy chain complementarity determining region 3 for antibody 57622
AKAGDYYGSRSPFDY

SEQ ID NO: 115245 - protein, 9 aa, Homo sapiens
  light chain complementarity determining region 3 for antibody 57623
QKYNSAPWT

SEQ ID NO: 115246 - protein, 15 aa, Homo sapiens
  heavy chain complementarity determining region 3 for antibody 57623
AKAGDYYGSGSPCDY

SEQ ID NO: 115247 - protein, 9 aa, Homo sapiens
  light chain complementarity determining region 3 for antibody 57624
QKYNSAPWT

SEQ ID NO: 115248 - protein, 15 aa, Homo sapiens
  heavy chain complementarity determining region 3 for antibody 57624
AKAGDYYGAGRPFDY

SEQ ID NO: 115249 - protein, 9 aa, Homo sapiens
  light chain complementarity determining region 3 for antibody 57625
QKYNSAPWT

SEQ ID NO: 115250 - protein, 15 aa, Homo sapiens
  heavy chain complementarity determining region 3 for antibody 57625
AKAGDYHGSGSPFDY

SEQ ID NO: 115251 - protein, 9 aa, Homo sapiens
  light chain complementarity determining region 3 for antibody 57626
QKYNSAPWT

SEQ ID NO: 115252 - protein, 15 aa, Homo sapiens
  heavy chain complementarity determining region 3 for antibody 57626
AKAEDYYGSGSPFDY

SEQ ID NO: 115253 - protein, 9 aa, Homo sapiens
  light chain complementarity determining region 3 for antibody 57627
QKHNSAPWT

SEQ ID NO: 115254 - protein, 15 aa, Homo sapiens
  heavy chain complementarity determining region 3 for antibody 57627
AKAGDYYGSGSPFDY

SEQ ID NO: 115255 - protein, 9 aa, Homo sapiens
  light chain complementarity determining region 3 for antibody 57628
LRHNSYPWT

SEQ ID NO: 115256 - protein, 17 aa, Homo sapiens
  heavy chain complementarity determining region 3 for antibody 57628
ARDDYGDYGYYYYGMDV

SEQ ID NO: 115257 - protein, 9 aa, Homo sapiens
  light chain complementarity determining region 3 for antibody 57629
LQHYSYPYT

SEQ ID NO: 115258 - protein, 18 aa, Homo sapiens
  heavy chain complementarity determining region 3 for antibody 57629
ARESSGGGGYYYYYGMDV

SEQ ID NO: 115259 - protein, 9 aa, Homo sapiens
  light chain complementarity determining region 3 for antibody 57630
LQHNSYPYT

SEQ ID NO: 115260 - protein, 12 aa, Homo sapiens
  heavy chain complementarity determining region 3 for antibody 57630
AKDRTYYYGMDV

SEQ ID NO: 115261 - protein, 9 aa, Homo sapiens
  light chain complementarity determining region 3 for antibody 57631
LQHNSYPWT

SEQ ID NO: 115262 - protein, 22 aa, Homo sapiens
  heavy chain complementarity determining region 3 for antibody 57631
ARDFPLYYDILTGYPHYHGMDV

SEQ ID NO: 115263 - protein, 9 aa, Homo sapiens
  light chain complementarity determining region 3 for antibody 57632
LQHNSYPFT

SEQ ID NO: 115264 - protein, 10 aa, Homo sapiens
  heavy chain complementarity determining region 3 for antibody 57632
ARDSSGWMDY

SEQ ID NO: 115265 - protein, 9 aa, Homo sapiens
  light chain complementarity determining region 3 for antibody 57633
LQDYNYPYT

SEQ ID NO: 115266 - protein, 18 aa, Homo sapiens
  heavy chain complementarity determining region 3 for antibody 57633
AKRGTMVRGVIIWYYFDY

SEQ ID NO: 115267 - protein, 9 aa, Homo sapiens
  light chain complementarity determining region 3 for antibody 57634
LQDYNYPYS

SEQ ID NO: 115268 - protein, 22 aa, Homo sapiens
  heavy chain complementarity determining region 3 for antibody 57634
AREAPLLRLGGLSYGGYYGMDV

SEQ ID NO: 115269 - protein, 9 aa, Homo sapiens
  light chain complementarity determining region 3 for antibody 57635
LQDYNYPWT

SEQ ID NO: 115270 - protein, 11 aa, Homo sapiens
  heavy chain complementarity determining region 3 for antibody 57635
ATGSPLPWFGD

SEQ ID NO: 115271 - protein, 9 aa, Homo sapiens
  light chain complementarity determining region 3 for antibody 57636
LQDYNYPRT

SEQ ID NO: 115272 - protein, 15 aa, Homo sapiens
  heavy chain complementarity determining region 3 for antibody 57636
ARVSWSGEWGDAFDI

SEQ ID NO: 115273 - protein, 9 aa, Homo sapiens
  light chain complementarity determining region 3 for antibody 57637
LQDYNYPRT

SEQ ID NO: 115274 - protein, 9 aa, Homo sapiens
  heavy chain complementarity determining region 3 for antibody 57637
AREGGGGSY

SEQ ID NO: 115275 - protein, 9 aa, Homo sapiens
  light chain complementarity determining region 3 for antibody 57638
LQDYNFPLT

SEQ ID NO: 115276 - protein, 12 aa, Homo sapiens
  heavy chain complementarity determining region 3 for antibody 57638
AKERGWSAYFDY

SEQ ID NO: 115277 - protein, 9 aa, Homo sapiens
  light chain complementarity determining region 3 for antibody 57639
KQYNSYPYT

SEQ ID NO: 115278 - protein, 18 aa, Homo sapiens
  heavy chain complementarity determining region 3 for antibody 57639
ARDGHYYGSGSYEDWFDP

SEQ ID NO: 115279 - protein, 9 aa, Homo sapiens
  light chain complementarity determining region 3 for antibody 57640
HQSSSLPHT

SEQ ID NO: 115280 - protein, 13 aa, Homo sapiens
  heavy chain complementarity determining region 3 for antibody 57640
ARGGYYGSGCLDY

SEQ ID NO: 115281 - protein, 9 aa, Homo sapiens
  light chain complementarity determining region 3 for antibody 57641
HQSSSLPHT

SEQ ID NO: 115282 - protein, 5 aa, Homo sapiens
  heavy chain complementarity determining region 3 for antibody 57641
ARGGY

SEQ ID NO: 115283 - protein, 9 aa, Homo sapiens
  light chain complementarity determining region 3 for antibody 57642
HQSSSLPHT

SEQ ID NO: 115284 - protein, 15 aa, Homo sapiens
  heavy chain complementarity determining region 3 for antibody 57642
AKAGDYYGSGSPFDY

SEQ ID NO: 115285 - protein, 9 aa, Homo sapiens
  light chain complementarity determining region 3 for antibody 57643
HQGSSLPHT

SEQ ID NO: 115286 - protein, 13 aa, Homo sapiens
  heavy chain complementarity determining region 3 for antibody 57643
ARGGYYGSGSLDY

SEQ ID NO: 115287 - protein, 9 aa, Homo sapiens
  light chain complementarity determining region 3 for antibody 57644
QQYNSYPRT

SEQ ID NO: 115288 - protein, 21 aa, Homo sapiens
  heavy chain complementarity determining region 3 for antibody 57644
ARETDYDILTGPYSNYYTMDV

SEQ ID NO: 115289 - protein, 9 aa, Homo sapiens
  light chain complementarity determining region 3 for antibody 57645
QQYNSYPRT

SEQ ID NO: 115290 - protein, 21 aa, Homo sapiens
  heavy chain complementarity determining region 3 for antibody 57645
ARETDDDILTGPYYNYYTMDV

SEQ ID NO: 115291 - protein, 9 aa, Homo sapiens
  light chain complementarity determining region 3 for antibody 57646
QQYGSSPRT

SEQ ID NO: 115292 - protein, 14 aa, Homo sapiens
  heavy chain complementarity determining region 3 for antibody 57646
AKERLRYFDWSLDY

SEQ ID NO: 115293 - protein, 9 aa, Homo sapiens
  light chain complementarity determining region 3 for antibody 57647
QQYGSSPPT

SEQ ID NO: 115294 - protein, 9 aa, Homo sapiens
  heavy chain complementarity determining region 3 for antibody 57647
ARGGGLFDY

SEQ ID NO: 115295 - protein, 9 aa, Homo sapiens
  light chain complementarity determining region 3 for antibody 57648
QQYGSPPRT

SEQ ID NO: 115296 - protein, 14 aa, Homo sapiens
  heavy chain complementarity determining region 3 for antibody 57648
AKERLRYFDWFLDY

SEQ ID NO: 115297 - protein, 9 aa, Homo sapiens
  light chain complementarity determining region 3 for antibody 57649
QQLNTYPLT

SEQ ID NO: 115298 - protein, 9 aa, Homo sapiens
  heavy chain complementarity determining region 3 for antibody 57649
ARKKGPFDY

SEQ ID NO: 115299 - protein, 9 aa, Homo sapiens
  light chain complementarity determining region 3 for antibody 57650
QQLNSYPRT

SEQ ID NO: 115300 - protein, 22 aa, Homo sapiens
  heavy chain complementarity determining region 3 for antibody 57650
TKDPGGIVAKTRDYQYFYGVDV

SEQ ID NO: 115301 - protein, 9 aa, Homo sapiens
  light chain complementarity determining region 3 for antibody 57651
QQLNSYPRT

SEQ ID NO: 115302 - protein, 11 aa, Homo sapiens
  heavy chain complementarity determining region 3 for antibody 57651
ARDRRYYGMDA

SEQ ID NO: 115303 - protein, 9 aa, Homo sapiens
  light chain complementarity determining region 3 for antibody 57652
QQLNSYPPT

SEQ ID NO: 115304 - protein, 12 aa, Homo sapiens
  heavy chain complementarity determining region 3 for antibody 57652
ARMVRGVIPFDY

SEQ ID NO: 115305 - protein, 9 aa, Homo sapiens
  light chain complementarity determining region 3 for antibody 57653
QQLNSYPLT

SEQ ID NO: 115306 - protein, 12 aa, Homo sapiens
  heavy chain complementarity determining region 3 for antibody 57653
ARVVRGVIPFDY

SEQ ID NO: 115307 - protein, 9 aa, Homo sapiens
  light chain complementarity determining region 3 for antibody 57654
QQLNSYPLT

SEQ ID NO: 115308 - protein, 12 aa, Homo sapiens
  heavy chain complementarity determining region 3 for antibody 57654
ARMVRGVLPFDY

SEQ ID NO: 115309 - protein, 9 aa, Homo sapiens
  light chain complementarity determining region 3 for antibody 57655
QQLNSYPLT

SEQ ID NO: 115310 - protein, 15 aa, Homo sapiens
  heavy chain complementarity determining region 3 for antibody 57655
ARDGGYSGYPTGMDV

SEQ ID NO: 115311 - protein, 9 aa, Homo sapiens
  light chain complementarity determining region 3 for antibody 57656
QQINSYPRT

SEQ ID NO: 115312 - protein, 11 aa, Homo sapiens
  heavy chain complementarity determining region 3 for antibody 57656
AREHYYYGMDV

SEQ ID NO: 115313 - protein, 9 aa, Homo sapiens
  light chain complementarity determining region 3 for antibody 57657
QQFFNYPYT

SEQ ID NO: 115314 - protein, 11 aa, Homo sapiens
  heavy chain complementarity determining region 3 for antibody 57657
ARDPRTAGFDC

SEQ ID NO: 115315 - protein, 8 aa, Homo sapiens
  light chain complementarity determining region 3 for antibody 57658
QQDYNLFT

SEQ ID NO: 115316 - protein, 16 aa, Homo sapiens
  heavy chain complementarity determining region 3 for antibody 57658
AKGGGSGSYFYYGLDV

SEQ ID NO: 115317 - protein, 9 aa, Homo sapiens
  light chain complementarity determining region 3 for antibody 57659
QQCYSTPRT

SEQ ID NO: 115318 - protein, 20 aa, Homo sapiens
  heavy chain complementarity determining region 3 for antibody 57659
ARDAGVWFVDPYSYYNGMDV

SEQ ID NO: 115319 - protein, 9 aa, Homo sapiens
  light chain complementarity determining region 3 for antibody 57660
QKYNSAQWT

SEQ ID NO: 115320 - protein, 15 aa, Homo sapiens
  heavy chain complementarity determining region 3 for antibody 57660
AKAGDYYGSGSPFDY

SEQ ID NO: 115321 - protein, 9 aa, Homo sapiens
  light chain complementarity determining region 3 for antibody 57661
QKYNSAPWT

SEQ ID NO: 115322 - protein, 13 aa, Homo sapiens
  heavy chain complementarity determining region 3 for antibody 57661
ARGGYYGSGSLDY

SEQ ID NO: 115323 - protein, 9 aa, Homo sapiens
  light chain complementarity determining region 3 for antibody 57662
QKYNSAPWT

SEQ ID NO: 115324 - protein, 15 aa, Homo sapiens
  heavy chain complementarity determining region 3 for antibody 57662
AQAGDYYGSGSPFDY

SEQ ID NO: 115325 - protein, 9 aa, Homo sapiens
  light chain complementarity determining region 3 for antibody 57663
QKYNSAPLT

SEQ ID NO: 115326 - protein, 16 aa, Homo sapiens
  heavy chain complementarity determining region 3 for antibody 57663
ARTFYGILTGYSPFDH

SEQ ID NO: 115327 - protein, 9 aa, Homo sapiens
  light chain complementarity determining region 3 for antibody 57664
QKYDSAPWT

SEQ ID NO: 115328 - protein, 15 aa, Homo sapiens
  heavy chain complementarity determining region 3 for antibody 57664
AKAGDYYGSGSPSDY

SEQ ID NO: 115329 - protein, 9 aa, Homo sapiens
  light chain complementarity determining region 3 for antibody 57665
QKCNSAPWT

SEQ ID NO: 115330 - protein, 15 aa, Homo sapiens
  heavy chain complementarity determining region 3 for antibody 57665
AKAGDYYGSGSPFDY

SEQ ID NO: 115331 - protein, 9 aa, Homo sapiens
  light chain complementarity determining region 3 for antibody 57666
LQHNSYPYT

SEQ ID NO: 115332 - protein, 12 aa, Homo sapiens
  heavy chain complementarity determining region 3 for antibody 57666
AKDRSYYYGMDD

SEQ ID NO: 115333 - protein, 9 aa, Homo sapiens
  light chain complementarity determining region 3 for antibody 57667
LQHNSYPYT

SEQ ID NO: 115334 - protein, 12 aa, Homo sapiens
  heavy chain complementarity determining region 3 for antibody 57667
AKDRSYYYGMAV

SEQ ID NO: 115335 - protein, 9 aa, Homo sapiens
  light chain complementarity determining region 3 for antibody 57668
LQHNSYPYT

SEQ ID NO: 115336 - protein, 12 aa, Homo sapiens
  heavy chain complementarity determining region 3 for antibody 57668
AKDRSYYYGIDV

SEQ ID NO: 115337 - protein, 9 aa, Homo sapiens
  light chain complementarity determining region 3 for antibody 57669
LQHNSYPYT

SEQ ID NO: 115338 - protein, 12 aa, Homo sapiens
  heavy chain complementarity determining region 3 for antibody 57669
AKDRSYYDGMDV

SEQ ID NO: 115339 - protein, 9 aa, Homo sapiens
  light chain complementarity determining region 3 for antibody 57670
LQHNSYPYT

SEQ ID NO: 115340 - protein, 12 aa, Homo sapiens
  heavy chain complementarity determining region 3 for antibody 57670
AKDRRYYYGMDV

SEQ ID NO: 115341 - protein, 9 aa, Homo sapiens
  light chain complementarity determining region 3 for antibody 57671
LQHNSYPWT

SEQ ID NO: 115342 - protein, 22 aa, Homo sapiens
  heavy chain complementarity determining region 3 for antibody 57671
ARDLPLYYDILTGYPYYHGMDV

SEQ ID NO: 115343 - protein, 9 aa, Homo sapiens
  light chain complementarity determining region 3 for antibody 57672
LQHNSYPRT

SEQ ID NO: 115344 - protein, 13 aa, Homo sapiens
  heavy chain complementarity determining region 3 for antibody 57672
AREYCSSPSCYDH

SEQ ID NO: 115345 - protein, 9 aa, Homo sapiens
  light chain complementarity determining region 3 for antibody 57673
LQHNSYPFT

SEQ ID NO: 115346 - protein, 10 aa, Homo sapiens
  heavy chain complementarity determining region 3 for antibody 57673
ARDSRGWLDY

SEQ ID NO: 115347 - protein, 9 aa, Homo sapiens
  light chain complementarity determining region 3 for antibody 57674
LQDYNYPYT

SEQ ID NO: 115348 - protein, 11 aa, Homo sapiens
  heavy chain complementarity determining region 3 for antibody 57674
ARDGGSYSFDY

SEQ ID NO: 115349 - protein, 9 aa, Homo sapiens
  light chain complementarity determining region 3 for antibody 57675
LQDYNYPWT

SEQ ID NO: 115350 - protein, 14 aa, Homo sapiens
  heavy chain complementarity determining region 3 for antibody 57675
AGRHYDILTGCSDY

SEQ ID NO: 115351 - protein, 9 aa, Homo sapiens
  light chain complementarity determining region 3 for antibody 57676
LQDYNYPWT

SEQ ID NO: 115352 - protein, 17 aa, Homo sapiens
  heavy chain complementarity determining region 3 for antibody 57676
AGDRLVRGVDYYYGMDV

SEQ ID NO: 115353 - protein, 9 aa, Homo sapiens
  light chain complementarity determining region 3 for antibody 57677
LQDYNYPRT

SEQ ID NO: 115354 - protein, 15 aa, Homo sapiens
  heavy chain complementarity determining region 3 for antibody 57677
ARGPAMVRGVIPFDY

SEQ ID NO: 115355 - protein, 9 aa, Homo sapiens
  light chain complementarity determining region 3 for antibody 57678
LQDYNYPRT

SEQ ID NO: 115356 - protein, 9 aa, Homo sapiens
  heavy chain complementarity determining region 3 for antibody 57678
ARDGGGGGY

SEQ ID NO: 115357 - protein, 9 aa, Homo sapiens
  light chain complementarity determining region 3 for antibody 57679
LQDYNCPRT

SEQ ID NO: 115358 - protein, 14 aa, Homo sapiens
  heavy chain complementarity determining region 3 for antibody 57679
ARREEDYYYYGLDV

SEQ ID NO: 115359 - protein, 9 aa, Homo sapiens
  light chain complementarity determining region 3 for antibody 57680
IQGTHWPYT

SEQ ID NO: 115360 - protein, 11 aa, Homo sapiens
  heavy chain complementarity determining region 3 for antibody 57680
ARDPNWKVFDY

SEQ ID NO: 115361 - protein, 9 aa, Homo sapiens
  light chain complementarity determining region 3 for antibody 57681
HQSSSLPQT

SEQ ID NO: 115362 - protein, 13 aa, Homo sapiens
  heavy chain complementarity determining region 3 for antibody 57681
ARGGYYGSGSLDY

SEQ ID NO: 115363 - protein, 9 aa, Homo sapiens
  light chain complementarity determining region 3 for antibody 57682
HQSSSLPPT

SEQ ID NO: 115364 - protein, 13 aa, Homo sapiens
  heavy chain complementarity determining region 3 for antibody 57682
ARGGYYGSGSLDY

SEQ ID NO: 115365 - protein, 9 aa, Homo sapiens
  light chain complementarity determining region 3 for antibody 57683
HQSSSLPLT

SEQ ID NO: 115366 - protein, 13 aa, Homo sapiens
  heavy chain complementarity determining region 3 for antibody 57683
ARGGYYGSGRLDY

SEQ ID NO: 115367 - protein, 9 aa, Homo sapiens
  light chain complementarity determining region 3 for antibody 57684
HQSSSLPIT

SEQ ID NO: 115368 - protein, 18 aa, Homo sapiens
  heavy chain complementarity determining region 3 for antibody 57684
AREELTGGYYDYYYGMDV

SEQ ID NO: 115369 - protein, 9 aa, Homo sapiens
  light chain complementarity determining region 3 for antibody 57685
HQSSSLPHT

SEQ ID NO: 115370 - protein, 13 aa, Homo sapiens
  heavy chain complementarity determining region 3 for antibody 57685
SRGGYYGSGSLDY

SEQ ID NO: 115371 - protein, 9 aa, Homo sapiens
  light chain complementarity determining region 3 for antibody 57686
HQSSSLPHT

SEQ ID NO: 115372 - protein, 13 aa, Homo sapiens
  heavy chain complementarity determining region 3 for antibody 57686
ARGGYYGSGSLEY

SEQ ID NO: 115373 - protein, 9 aa, Homo sapiens
  light chain complementarity determining region 3 for antibody 57687
HQSSSLPHT

SEQ ID NO: 115374 - protein, 13 aa, Homo sapiens
  heavy chain complementarity determining region 3 for antibody 57687
ARGGYYGSGGIDY

SEQ ID NO: 115375 - protein, 9 aa, Homo sapiens
  light chain complementarity determining region 3 for antibody 57688
HQSSSLPHT

SEQ ID NO: 115376 - protein, 15 aa, Homo sapiens
  heavy chain complementarity determining region 3 for antibody 57688
ARDGYSGYDWGVFDY

SEQ ID NO: 115377 - protein, 9 aa, Homo sapiens
  light chain complementarity determining region 3 for antibody 57689
HQSSSLPHN

SEQ ID NO: 115378 - protein, 13 aa, Homo sapiens
  heavy chain complementarity determining region 3 for antibody 57689
ARGGYYGSGSLDY

SEQ ID NO: 115379 - protein, 9 aa, Homo sapiens
  light chain complementarity determining region 3 for antibody 57690
HQSGSLPHT

SEQ ID NO: 115380 - protein, 13 aa, Homo sapiens
  heavy chain complementarity determining region 3 for antibody 57690
ARGGYYGSGSLDY

SEQ ID NO: 115381 - protein, 9 aa, Homo sapiens
  light chain complementarity determining region 3 for antibody 57691
QRTYNAPYT

SEQ ID NO: 115382 - protein, 18 aa, Homo sapiens
  heavy chain complementarity determining region 3 for antibody 57691
AGDMIAAAGTDYYYGMDV

SEQ ID NO: 115383 - protein, 9 aa, Homo sapiens
  light chain complementarity determining region 3 for antibody 57692
QQYNSYPYT

SEQ ID NO: 115384 - protein, 10 aa, Homo sapiens
  heavy chain complementarity determining region 3 for antibody 57692
ARGGLGAFDY

SEQ ID NO: 115385 - protein, 9 aa, Homo sapiens
  light chain complementarity determining region 3 for antibody 57693
QQYNSYPRT

SEQ ID NO: 115386 - protein, 21 aa, Homo sapiens
  heavy chain complementarity determining region 3 for antibody 57693
ARETDYDILTGPYYNYYPMDV

SEQ ID NO: 115387 - protein, 9 aa, Homo sapiens
  light chain complementarity determining region 3 for antibody 57694
QQYNSYPPT

SEQ ID NO: 115388 - protein, 14 aa, Homo sapiens
  heavy chain complementarity determining region 3 for antibody 57694
ARDHSGSYSNWFDP

SEQ ID NO: 115389 - protein, 9 aa, Homo sapiens
  light chain complementarity determining region 3 for antibody 57695
QQYNSYPLT

SEQ ID NO: 115390 - protein, 17 aa, Homo sapiens
  heavy chain complementarity determining region 3 for antibody 57695
ARERITMVRGVYNWFDP

SEQ ID NO: 115391 - protein, 9 aa, Homo sapiens
  light chain complementarity determining region 3 for antibody 57696
QQYNSYPLT

SEQ ID NO: 115392 - protein, 9 aa, Homo sapiens
  heavy chain complementarity determining region 3 for antibody 57696
AIAAADTDY

SEQ ID NO: 115393 - protein, 9 aa, Homo sapiens
  light chain complementarity determining region 3 for antibody 57697
QQYNSAPWT

SEQ ID NO: 115394 - protein, 15 aa, Homo sapiens
  heavy chain complementarity determining region 3 for antibody 57697
AKAGDYYGSGSPFDY

SEQ ID NO: 115395 - protein, 8 aa, Homo sapiens
  light chain complementarity determining region 3 for antibody 57698
QQYGSSYT

SEQ ID NO: 115396 - protein, 20 aa, Homo sapiens
  heavy chain complementarity determining region 3 for antibody 57698
ARDRVLWFGELSYYYYGLDV

SEQ ID NO: 115397 - protein, 9 aa, Homo sapiens
  light chain complementarity determining region 3 for antibody 57699
QQYDNLPLT

SEQ ID NO: 115398 - protein, 14 aa, Homo sapiens
  heavy chain complementarity determining region 3 for antibody 57699
ARGRGGSYWGWFDP

SEQ ID NO: 115399 - protein, 10 aa, Homo sapiens
  light chain complementarity determining region 3 for antibody 57700
QQRSNWPLLT

SEQ ID NO: 115400 - protein, 7 aa, Homo sapiens
  heavy chain complementarity determining region 3 for antibody 57700
AREATDL

SEQ ID NO: 115401 - protein, 9 aa, Homo sapiens
  light chain complementarity determining region 3 for antibody 57701
QQLNSYPPT

SEQ ID NO: 115402 - protein, 11 aa, Homo sapiens
  heavy chain complementarity determining region 3 for antibody 57701
ARVAAARGMDV

SEQ ID NO: 115403 - protein, 9 aa, Homo sapiens
  light chain complementarity determining region 3 for antibody 57702
QQLNSYPPT

SEQ ID NO: 115404 - protein, 13 aa, Homo sapiens
  heavy chain complementarity determining region 3 for antibody 57702
ARSFLTSYSPIDY

SEQ ID NO: 115405 - protein, 9 aa, Homo sapiens
  light chain complementarity determining region 3 for antibody 57703
QQLNSYPLT

SEQ ID NO: 115406 - protein, 12 aa, Homo sapiens
  heavy chain complementarity determining region 3 for antibody 57703
ARMVRVVIPFDY

SEQ ID NO: 115407 - protein, 9 aa, Homo sapiens
  light chain complementarity determining region 3 for antibody 57704
QQLNSYPLT

SEQ ID NO: 115408 - protein, 12 aa, Homo sapiens
  heavy chain complementarity determining region 3 for antibody 57704
ARMVRGFIPFDY

SEQ ID NO: 115409 - protein, 9 aa, Homo sapiens
  light chain complementarity determining region 3 for antibody 57705
QQLNSYPLT

SEQ ID NO: 115410 - protein, 12 aa, Homo sapiens
  heavy chain complementarity determining region 3 for antibody 57705
ARMARGVIPFDY

SEQ ID NO: 115411 - protein, 9 aa, Homo sapiens
  light chain complementarity determining region 3 for antibody 57706
QQLNSYPLT

SEQ ID NO: 115412 - protein, 15 aa, Homo sapiens
  heavy chain complementarity determining region 3 for antibody 57706
ARDGGYSGSPIGMDV

SEQ ID NO: 115413 - protein, 9 aa, Homo sapiens
  light chain complementarity determining region 3 for antibody 57707
QQLNSYPIT

SEQ ID NO: 115414 - protein, 12 aa, Homo sapiens
  heavy chain complementarity determining region 3 for antibody 57707
ARMVRGVIPFDY

SEQ ID NO: 115415 - protein, 9 aa, Homo sapiens
  light chain complementarity determining region 3 for antibody 57708
QQFYNYPHT

SEQ ID NO: 115416 - protein, 13 aa, Homo sapiens
  heavy chain complementarity determining region 3 for antibody 57708
GRFLGGIGGAFDI

SEQ ID NO: 115417 - protein, 8 aa, Homo sapiens
  light chain complementarity determining region 3 for antibody 57709
QQFNSYPT

SEQ ID NO: 115418 - protein, 13 aa, Homo sapiens
  heavy chain complementarity determining region 3 for antibody 57709
ARDVTGTSSGFDY

SEQ ID NO: 115419 - protein, 8 aa, Homo sapiens
  light chain complementarity determining region 3 for antibody 57710
QQFNNYRT

SEQ ID NO: 115420 - protein, 10 aa, Homo sapiens
  heavy chain complementarity determining region 3 for antibody 57710
ARDGSYYLDY

SEQ ID NO: 115421 - protein, 9 aa, Homo sapiens
  light chain complementarity determining region 3 for antibody 57711
QQFNNYPYT

SEQ ID NO: 115422 - protein, 17 aa, Homo sapiens
  heavy chain complementarity determining region 3 for antibody 57711
AREGYYYGAGSYYTFDY

SEQ ID NO: 115423 - protein, 9 aa, Homo sapiens
  light chain complementarity determining region 3 for antibody 57712
QQFNNYPLT

SEQ ID NO: 115424 - protein, 22 aa, Homo sapiens
  heavy chain complementarity determining region 3 for antibody 57712
AKQSHYYDSGSYRHYYYYGMDV

SEQ ID NO: 115425 - protein, 9 aa, Homo sapiens
  light chain complementarity determining region 3 for antibody 57713
QQDYNYPWT

SEQ ID NO: 115426 - protein, 11 aa, Homo sapiens
  heavy chain complementarity determining region 3 for antibody 57713
AREGAVAGVDY

SEQ ID NO: 115427 - protein, 9 aa, Homo sapiens
  light chain complementarity determining region 3 for antibody 57714
QQDYNLPLT

SEQ ID NO: 115428 - protein, 19 aa, Homo sapiens
  heavy chain complementarity determining region 3 for antibody 57714
ARGEYYGSGRYKDYYGMDV

SEQ ID NO: 115429 - protein, 9 aa, Homo sapiens
  light chain complementarity determining region 3 for antibody 57715
QKYNSAPWT

SEQ ID NO: 115430 - protein, 15 aa, Homo sapiens
  heavy chain complementarity determining region 3 for antibody 57715
SKAGDYYGSGSPFDY

SEQ ID NO: 115431 - protein, 9 aa, Homo sapiens
  light chain complementarity determining region 3 for antibody 57716
QKYNSAPWT

SEQ ID NO: 115432 - protein, 15 aa, Homo sapiens
  heavy chain complementarity determining region 3 for antibody 57716
AKEGDYYGSGSPFDY

SEQ ID NO: 115433 - protein, 9 aa, Homo sapiens
  light chain complementarity determining region 3 for antibody 57717
QKYNSAPWT

SEQ ID NO: 115434 - protein, 15 aa, Homo sapiens
  heavy chain complementarity determining region 3 for antibody 57717
AKAGDCYGSGSAFDY

SEQ ID NO: 115435 - protein, 9 aa, Homo sapiens
  light chain complementarity determining region 3 for antibody 57718
QKYNSAPWT

SEQ ID NO: 115436 - protein, 15 aa, Homo sapiens
  heavy chain complementarity determining region 3 for antibody 57718
AKAGDCYGSGRPFDY

SEQ ID NO: 115437 - protein, 9 aa, Homo sapiens
  light chain complementarity determining region 3 for antibody 57719
MQGTHWPLT

SEQ ID NO: 115438 - protein, 14 aa, Homo sapiens
  heavy chain complementarity determining region 3 for antibody 57719
ARDLGHYYYYGMDV

SEQ ID NO: 115439 - protein, 9 aa, Homo sapiens
  light chain complementarity determining region 3 for antibody 57720
MQALQTPLT

SEQ ID NO: 115440 - protein, 10 aa, Homo sapiens
  heavy chain complementarity determining region 3 for antibody 57720
ARDRVGATPY

SEQ ID NO: 115441 - protein, 9 aa, Homo sapiens
  light chain complementarity determining region 3 for antibody 57721
LQHTSYPYT

SEQ ID NO: 115442 - protein, 13 aa, Homo sapiens
  heavy chain complementarity determining region 3 for antibody 57721
ALNYGDYGDWFDP

SEQ ID NO: 115443 - protein, 9 aa, Homo sapiens
  light chain complementarity determining region 3 for antibody 57722
LQHNSYPYT

SEQ ID NO: 115444 - protein, 16 aa, Homo sapiens
  heavy chain complementarity determining region 3 for antibody 57722
AKDGAGSYYLTEYFQH

SEQ ID NO: 115445 - protein, 9 aa, Homo sapiens
  light chain complementarity determining region 3 for antibody 57723
LQHNSYPRT

SEQ ID NO: 115446 - protein, 13 aa, Homo sapiens
  heavy chain complementarity determining region 3 for antibody 57723
AREYCSSASCYDH

SEQ ID NO: 115447 - protein, 9 aa, Homo sapiens
  light chain complementarity determining region 3 for antibody 57724
LQHNSYPLT

SEQ ID NO: 115448 - protein, 13 aa, Homo sapiens
  heavy chain complementarity determining region 3 for antibody 57724
ARDRGSGWDYFDY

SEQ ID NO: 115449 - protein, 9 aa, Homo sapiens
  light chain complementarity determining region 3 for antibody 57725
LQHNSYPLT

SEQ ID NO: 115450 - protein, 10 aa, Homo sapiens
  heavy chain complementarity determining region 3 for antibody 57725
AKEGYRSRDY

SEQ ID NO: 115451 - protein, 9 aa, Homo sapiens
  light chain complementarity determining region 3 for antibody 57726
LQHNSYPFT

SEQ ID NO: 115452 - protein, 10 aa, Homo sapiens
  heavy chain complementarity determining region 3 for antibody 57726
ARDSSGWLAY

SEQ ID NO: 115453 - protein, 9 aa, Homo sapiens
  light chain complementarity determining region 3 for antibody 57727
LQHNSYPFT

SEQ ID NO: 115454 - protein, 10 aa, Homo sapiens
  heavy chain complementarity determining region 3 for antibody 57727
ARDSSGSLDY

SEQ ID NO: 115455 - protein, 9 aa, Homo sapiens
  light chain complementarity determining region 3 for antibody 57728
LQHDNFPYT

SEQ ID NO: 115456 - protein, 18 aa, Homo sapiens
  heavy chain complementarity determining region 3 for antibody 57728
AGDGGITMVRGILRGMDV

SEQ ID NO: 115457 - protein, 9 aa, Homo sapiens
  light chain complementarity determining region 3 for antibody 57729
LQHDNFPLT

SEQ ID NO: 115458 - protein, 17 aa, Homo sapiens
  heavy chain complementarity determining region 3 for antibody 57729
AREGYYYGSGSYYTFDY

SEQ ID NO: 115459 - protein, 9 aa, Homo sapiens
  light chain complementarity determining region 3 for antibody 57730
LQDYNYPYT

SEQ ID NO: 115460 - protein, 13 aa, Homo sapiens
  heavy chain complementarity determining region 3 for antibody 57730
AREWKRRGNYFDY

SEQ ID NO: 115461 - protein, 9 aa, Homo sapiens
  light chain complementarity determining region 3 for antibody 57731
LQDYNYPWT

SEQ ID NO: 115462 - protein, 11 aa, Homo sapiens
  heavy chain complementarity determining region 3 for antibody 57731
ATGSPSLWFGD

SEQ ID NO: 115463 - protein, 9 aa, Homo sapiens
  light chain complementarity determining region 3 for antibody 57732
LQDYNYPWT

SEQ ID NO: 115464 - protein, 11 aa, Homo sapiens
  heavy chain complementarity determining region 3 for antibody 57732
ATGSPFLWFAD

SEQ ID NO: 115465 - protein, 9 aa, Homo sapiens
  light chain complementarity determining region 3 for antibody 57733
LQDYNYPWT

SEQ ID NO: 115466 - protein, 13 aa, Homo sapiens
  heavy chain complementarity determining region 3 for antibody 57733
ARVRITGSYAFDI

SEQ ID NO: 115467 - protein, 9 aa, Homo sapiens
  light chain complementarity determining region 3 for antibody 57734
LQDYNYPWT

SEQ ID NO: 115468 - protein, 17 aa, Homo sapiens
  heavy chain complementarity determining region 3 for antibody 57734
ARERLVRGVDYYYGMDV

SEQ ID NO: 115469 - protein, 9 aa, Homo sapiens
  light chain complementarity determining region 3 for antibody 57735
LQDYNYPRT

SEQ ID NO: 115470 - protein, 9 aa, Homo sapiens
  heavy chain complementarity determining region 3 for antibody 57735
ARDGGGGTY

SEQ ID NO: 115471 - protein, 9 aa, Homo sapiens
  light chain complementarity determining region 3 for antibody 57736
LQDYNYPRT

SEQ ID NO: 115472 - protein, 9 aa, Homo sapiens
  heavy chain complementarity determining region 3 for antibody 57736
ARDGGGGRY

SEQ ID NO: 115473 - protein, 9 aa, Homo sapiens
  light chain complementarity determining region 3 for antibody 57737
LQDYNYPRT

SEQ ID NO: 115474 - protein, 13 aa, Homo sapiens
  heavy chain complementarity determining region 3 for antibody 57737
ALNYGDYGDWFDP

SEQ ID NO: 115475 - protein, 9 aa, Homo sapiens
  light chain complementarity determining region 3 for antibody 57738
LQDYNYPRT

SEQ ID NO: 115476 - protein, 17 aa, Homo sapiens
  heavy chain complementarity determining region 3 for antibody 57738
AKDSSWYRGYYYYGMDV

SEQ ID NO: 115477 - protein, 9 aa, Homo sapiens
  light chain complementarity determining region 3 for antibody 57739
LQDYNYPFT

SEQ ID NO: 115478 - protein, 15 aa, Homo sapiens
  heavy chain complementarity determining region 3 for antibody 57739
ASLTMVRGVMGYFDL

SEQ ID NO: 115479 - protein, 9 aa, Homo sapiens
  light chain complementarity determining region 3 for antibody 57740
LQDYNFPLT

SEQ ID NO: 115480 - protein, 22 aa, Homo sapiens
  heavy chain complementarity determining region 3 for antibody 57740
ARDVRDYDILTGYYNGKNYFDY

SEQ ID NO: 115481 - protein, 9 aa, Homo sapiens
  light chain complementarity determining region 3 for antibody 57741
LQDNNYPRT

SEQ ID NO: 115482 - protein, 19 aa, Homo sapiens
  heavy chain complementarity determining region 3 for antibody 57741
ARDLPYYDILTGYYPLFDY

SEQ ID NO: 115483 - protein, 9 aa, Homo sapiens
  light chain complementarity determining region 3 for antibody 57742
KQYNSYPYT

SEQ ID NO: 115484 - protein, 15 aa, Homo sapiens
  heavy chain complementarity determining region 3 for antibody 57742
AREQGYSGYWGHLDY

SEQ ID NO: 115485 - protein, 8 aa, Homo sapiens
  light chain complementarity determining region 3 for antibody 57743
HQSSSLPT

SEQ ID NO: 115486 - protein, 13 aa, Homo sapiens
  heavy chain complementarity determining region 3 for antibody 57743
ARDQDYGSGSPDY

SEQ ID NO: 115487 - protein, 9 aa, Homo sapiens
  light chain complementarity determining region 3 for antibody 57744
HQSSSLPLT

SEQ ID NO: 115488 - protein, 20 aa, Homo sapiens
  heavy chain complementarity determining region 3 for antibody 57744
ATPYYYGSGSYYNYYYGMDV

SEQ ID NO: 115489 - protein, 9 aa, Homo sapiens
  light chain complementarity determining region 3 for antibody 57745
HQSSSLPLT

SEQ ID NO: 115490 - protein, 13 aa, Homo sapiens
  heavy chain complementarity determining region 3 for antibody 57745
AGGGYYGSGSLDY

SEQ ID NO: 115491 - protein, 9 aa, Homo sapiens
  light chain complementarity determining region 3 for antibody 57746
HQSSSLPHT

SEQ ID NO: 115492 - protein, 13 aa, Homo sapiens
  heavy chain complementarity determining region 3 for antibody 57746
ARGVYYGSGSLDY

SEQ ID NO: 115493 - protein, 9 aa, Homo sapiens
  light chain complementarity determining region 3 for antibody 57747
HQSSSLPHT

SEQ ID NO: 115494 - protein, 13 aa, Homo sapiens
  heavy chain complementarity determining region 3 for antibody 57747
ARGGYYGLGSLDY

SEQ ID NO: 115495 - protein, 9 aa, Homo sapiens
  light chain complementarity determining region 3 for antibody 57748
HQSSSLPHT

SEQ ID NO: 115496 - protein, 13 aa, Homo sapiens
  heavy chain complementarity determining region 3 for antibody 57748
ARGGYYCSGSLDY

SEQ ID NO: 115497 - protein, 9 aa, Homo sapiens
  light chain complementarity determining region 3 for antibody 57749
HQSSSLPHT

SEQ ID NO: 115498 - protein, 13 aa, Homo sapiens
  heavy chain complementarity determining region 3 for antibody 57749
ARGGYCGSGSLDY

SEQ ID NO: 115499 - protein, 9 aa, Homo sapiens
  light chain complementarity determining region 3 for antibody 57750
HQSSRLPHT

SEQ ID NO: 115500 - protein, 13 aa, Homo sapiens
  heavy chain complementarity determining region 3 for antibody 57750
ARGGYYGSGSLDY

SEQ ID NO: 115501 - protein, 9 aa, Homo sapiens
  light chain complementarity determining region 3 for antibody 57751
QQYNSYPRT

SEQ ID NO: 115502 - protein, 21 aa, Homo sapiens
  heavy chain complementarity determining region 3 for antibody 57751
ARETDYDILTGPYYNSYTMDV

SEQ ID NO: 115503 - protein, 9 aa, Homo sapiens
  light chain complementarity determining region 3 for antibody 57752
QQYNSYPPT

SEQ ID NO: 115504 - protein, 13 aa, Homo sapiens
  heavy chain complementarity determining region 3 for antibody 57752
ARLGSGSSHVFDI

SEQ ID NO: 115505 - protein, 9 aa, Homo sapiens
  light chain complementarity determining region 3 for antibody 57753
QQYNSYPPT

SEQ ID NO: 115506 - protein, 14 aa, Homo sapiens
  heavy chain complementarity determining region 3 for antibody 57753
ARDHSGSSFNWFDP

SEQ ID NO: 115507 - protein, 9 aa, Homo sapiens
  light chain complementarity determining region 3 for antibody 57754
QQYNSYPLT

SEQ ID NO: 115508 - protein, 17 aa, Homo sapiens
  heavy chain complementarity determining region 3 for antibody 57754
ARDRITMVRGVYNWFDH

SEQ ID NO: 115509 - protein, 9 aa, Homo sapiens
  light chain complementarity determining region 3 for antibody 57755
QQYNNWPRT

SEQ ID NO: 115510 - protein, 17 aa, Homo sapiens
  heavy chain complementarity determining region 3 for antibody 57755
AKEIVVVTEEVYWYFDL

SEQ ID NO: 115511 - protein, 9 aa, Homo sapiens
  light chain complementarity determining region 3 for antibody 57756
QQYNNWPLT

SEQ ID NO: 115512 - protein, 18 aa, Homo sapiens
  heavy chain complementarity determining region 3 for antibody 57756
TRDLRPPGIAVAEGALDI

SEQ ID NO: 115513 - protein, 8 aa, Homo sapiens
  light chain complementarity determining region 3 for antibody 57757
QQYGSSPT

SEQ ID NO: 115514 - protein, 9 aa, Homo sapiens
  heavy chain complementarity determining region 3 for antibody 57757
AMGRALFDY

SEQ ID NO: 115515 - protein, 9 aa, Homo sapiens
  light chain complementarity determining region 3 for antibody 57758
QQYGSSPFT

SEQ ID NO: 115516 - protein, 10 aa, Homo sapiens
  heavy chain complementarity determining region 3 for antibody 57758
ATQRLGIFDY

SEQ ID NO: 115517 - protein, 9 aa, Homo sapiens
  light chain complementarity determining region 3 for antibody 57759
QQSFNYPYT

SEQ ID NO: 115518 - protein, 11 aa, Homo sapiens
  heavy chain complementarity determining region 3 for antibody 57759
ARDPRIAGFDC

SEQ ID NO: 115519 - protein, 10 aa, Homo sapiens
  light chain complementarity determining region 3 for antibody 57760
QQRSNWPPYT

SEQ ID NO: 115520 - protein, 19 aa, Homo sapiens
  heavy chain complementarity determining region 3 for antibody 57760
ARQTPIDQDFDWPYWCFDL

SEQ ID NO: 115521 - protein, 9 aa, Homo sapiens
  light chain complementarity determining region 3 for antibody 57761
QQRGNWPPT

SEQ ID NO: 115522 - protein, 15 aa, Homo sapiens
  heavy chain complementarity determining region 3 for antibody 57761
AKESYYYGSGSAFDY

SEQ ID NO: 115523 - protein, 9 aa, Homo sapiens
  light chain complementarity determining region 3 for antibody 57762
QQLNSYPYT

SEQ ID NO: 115524 - protein, 13 aa, Homo sapiens
  heavy chain complementarity determining region 3 for antibody 57762
ARGGYGDQYYFDD

SEQ ID NO: 115525 - protein, 9 aa, Homo sapiens
  light chain complementarity determining region 3 for antibody 57763
QQLNSYPRT

SEQ ID NO: 115526 - protein, 11 aa, Homo sapiens
  heavy chain complementarity determining region 3 for antibody 57763
ARDRRYYAMDV

SEQ ID NO: 115527 - protein, 9 aa, Homo sapiens
  light chain complementarity determining region 3 for antibody 57764
QQLNSYPRT

SEQ ID NO: 115528 - protein, 11 aa, Homo sapiens
  heavy chain complementarity determining region 3 for antibody 57764
ARDRRYSGMDV

SEQ ID NO: 115529 - protein, 9 aa, Homo sapiens
  light chain complementarity determining region 3 for antibody 57765
QQLNSYPRT

SEQ ID NO: 115530 - protein, 12 aa, Homo sapiens
  heavy chain complementarity determining region 3 for antibody 57765
ARDPYSSGGFDY

SEQ ID NO: 115531 - protein, 9 aa, Homo sapiens
  light chain complementarity determining region 3 for antibody 57766
QQLNSYPPT

SEQ ID NO: 115532 - protein, 12 aa, Homo sapiens
  heavy chain complementarity determining region 3 for antibody 57766
TFFSGTFNWFDH

SEQ ID NO: 115533 - protein, 9 aa, Homo sapiens
  light chain complementarity determining region 3 for antibody 57767
QQLNSYPPT

SEQ ID NO: 115534 - protein, 17 aa, Homo sapiens
  heavy chain complementarity determining region 3 for antibody 57767
ARDPLDYYGAGSSGMDV

SEQ ID NO: 115535 - protein, 9 aa, Homo sapiens
  light chain complementarity determining region 3 for antibody 57768
QQLNSYPLT

SEQ ID NO: 115536 - protein, 12 aa, Homo sapiens
  heavy chain complementarity determining region 3 for antibody 57768
ARMVRRVIPFDY

SEQ ID NO: 115537 - protein, 9 aa, Homo sapiens
  light chain complementarity determining region 3 for antibody 57769
QQLNSYPLT

SEQ ID NO: 115538 - protein, 12 aa, Homo sapiens
  heavy chain complementarity determining region 3 for antibody 57769
ARMVRGVIAFDY

SEQ ID NO: 115539 - protein, 9 aa, Homo sapiens
  light chain complementarity determining region 3 for antibody 57770
QQLNSYPFT

SEQ ID NO: 115540 - protein, 21 aa, Homo sapiens
  heavy chain complementarity determining region 3 for antibody 57770
ARGEDYYGSGTPSSYYYGMDV

SEQ ID NO: 115541 - protein, 9 aa, Homo sapiens
  light chain complementarity determining region 3 for antibody 57771
QQFYNYPRT

SEQ ID NO: 115542 - protein, 11 aa, Homo sapiens
  heavy chain complementarity determining region 3 for antibody 57771
AREIVGAHFDY

SEQ ID NO: 115543 - protein, 9 aa, Homo sapiens
  light chain complementarity determining region 3 for antibody 57772
QQFYNYPHT

SEQ ID NO: 115544 - protein, 13 aa, Homo sapiens
  heavy chain complementarity determining region 3 for antibody 57772
GRFLEGIGCAFDI

SEQ ID NO: 115545 - protein, 9 aa, Homo sapiens
  light chain complementarity determining region 3 for antibody 57773
QQFNSYPWT

SEQ ID NO: 115546 - protein, 13 aa, Homo sapiens
  heavy chain complementarity determining region 3 for antibody 57773
ARITMVRGVSFDY

SEQ ID NO: 115547 - protein, 9 aa, Homo sapiens
  light chain complementarity determining region 3 for antibody 57774
QQFNNYPYT

SEQ ID NO: 115548 - protein, 14 aa, Homo sapiens
  heavy chain complementarity determining region 3 for antibody 57774
AGRFRIAVAAPFDY

SEQ ID NO: 115549 - protein, 9 aa, Homo sapiens
  light chain complementarity determining region 3 for antibody 57775
QQFNNYPLT

SEQ ID NO: 115550 - protein, 22 aa, Homo sapiens
  heavy chain complementarity determining region 3 for antibody 57775
AKQAHYYDSESYRHYYYYGMDV

SEQ ID NO: 115551 - protein, 8 aa, Homo sapiens
  light chain complementarity determining region 3 for antibody 57776
QQFNNYFT

SEQ ID NO: 115552 - protein, 12 aa, Homo sapiens
  heavy chain complementarity determining region 3 for antibody 57776
ARAALYYYGMDV

SEQ ID NO: 115553 - protein, 9 aa, Homo sapiens
  light chain complementarity determining region 3 for antibody 57777
QQFNIYPYT

SEQ ID NO: 115554 - protein, 14 aa, Homo sapiens
  heavy chain complementarity determining region 3 for antibody 57777
ARRFRIAVSAPFDY

SEQ ID NO: 115555 - protein, 9 aa, Homo sapiens
  light chain complementarity determining region 3 for antibody 57778
QQFNIYPYT

SEQ ID NO: 115556 - protein, 14 aa, Homo sapiens
  heavy chain complementarity determining region 3 for antibody 57778
AGRFRIAVAAPFDY

SEQ ID NO: 115557 - protein, 9 aa, Homo sapiens
  light chain complementarity determining region 3 for antibody 57779
QKYNSAPWT

SEQ ID NO: 115558 - protein, 15 aa, Homo sapiens
  heavy chain complementarity determining region 3 for antibody 57779
AKAGYYYGSGSPFDY

SEQ ID NO: 115559 - protein, 9 aa, Homo sapiens
  light chain complementarity determining region 3 for antibody 57780
QKYNSAPWT

SEQ ID NO: 115560 - protein, 15 aa, Homo sapiens
  heavy chain complementarity determining region 3 for antibody 57780
AKAGDYYGSWRPFDY

SEQ ID NO: 115561 - protein, 9 aa, Homo sapiens
  light chain complementarity determining region 3 for antibody 57781
QKYNSAPWT

SEQ ID NO: 115562 - protein, 15 aa, Homo sapiens
  heavy chain complementarity determining region 3 for antibody 57781
AKAGDYYGSGSRFDY

SEQ ID NO: 115563 - protein, 9 aa, Homo sapiens
  light chain complementarity determining region 3 for antibody 57782
QKYNSAPWT

SEQ ID NO: 115564 - protein, 15 aa, Homo sapiens
  heavy chain complementarity determining region 3 for antibody 57782
AKAGDYYGSGSPYDY

SEQ ID NO: 115565 - protein, 9 aa, Homo sapiens
  light chain complementarity determining region 3 for antibody 57783
QKYNSAPWT

SEQ ID NO: 115566 - protein, 15 aa, Homo sapiens
  heavy chain complementarity determining region 3 for antibody 57783
AKAGDYYASASPFDY

SEQ ID NO: 115567 - protein, 9 aa, Homo sapiens
  light chain complementarity determining region 3 for antibody 57784
QKYNSAPWT

SEQ ID NO: 115568 - protein, 15 aa, Homo sapiens
  heavy chain complementarity determining region 3 for antibody 57784
AKAGDYDGSGRPFDY

SEQ ID NO: 115569 - protein, 9 aa, Homo sapiens
  light chain complementarity determining region 3 for antibody 57785
QKYKSAPWT

SEQ ID NO: 115570 - protein, 15 aa, Homo sapiens
  heavy chain complementarity determining region 3 for antibody 57785
AKAGDYYGSGSPFDY

SEQ ID NO: 115571 - protein, 9 aa, Homo sapiens
  light chain complementarity determining region 3 for antibody 57786
QKDNSAPWT

SEQ ID NO: 115572 - protein, 15 aa, Homo sapiens
  heavy chain complementarity determining region 3 for antibody 57786
AKAGDYYGSGSPFDY

SEQ ID NO: 115573 - protein, 9 aa, Homo sapiens
  light chain complementarity determining region 3 for antibody 57787
MQALQTPYT

SEQ ID NO: 115574 - protein, 12 aa, Homo sapiens
  heavy chain complementarity determining region 3 for antibody 57787
AREGIMGGQLDV

SEQ ID NO: 115575 - protein, 9 aa, Homo sapiens
  light chain complementarity determining region 3 for antibody 57788
LQHNSYPYT

SEQ ID NO: 115576 - protein, 14 aa, Homo sapiens
  heavy chain complementarity determining region 3 for antibody 57788
ARGLRYCDWLSQDY

SEQ ID NO: 115577 - protein, 9 aa, Homo sapiens
  light chain complementarity determining region 3 for antibody 57789
LQHNSYPYT

SEQ ID NO: 115578 - protein, 12 aa, Homo sapiens
  heavy chain complementarity determining region 3 for antibody 57789
ANDRSYYYGMDV

SEQ ID NO: 115579 - protein, 9 aa, Homo sapiens
  light chain complementarity determining region 3 for antibody 57790
LQHNSYPYT

SEQ ID NO: 115580 - protein, 12 aa, Homo sapiens
  heavy chain complementarity determining region 3 for antibody 57790
AKDRSYYSGMDV

SEQ ID NO: 115581 - protein, 9 aa, Homo sapiens
  light chain complementarity determining region 3 for antibody 57791
LQHNSYPYT

SEQ ID NO: 115582 - protein, 12 aa, Homo sapiens
  heavy chain complementarity determining region 3 for antibody 57791
AKDRSYYCGMDV

SEQ ID NO: 115583 - protein, 9 aa, Homo sapiens
  light chain complementarity determining region 3 for antibody 57792
LQHNSYPYT

SEQ ID NO: 115584 - protein, 16 aa, Homo sapiens
  heavy chain complementarity determining region 3 for antibody 57792
AKDGSGSYYLTESFQH

SEQ ID NO: 115585 - protein, 9 aa, Homo sapiens
  light chain complementarity determining region 3 for antibody 57793
LQHNSYPYT

SEQ ID NO: 115586 - protein, 14 aa, Homo sapiens
  heavy chain complementarity determining region 3 for antibody 57793
AGGPYYYGSGTYDK

SEQ ID NO: 115587 - protein, 9 aa, Homo sapiens
  light chain complementarity determining region 3 for antibody 57794
LQHNSYPYT

SEQ ID NO: 115588 - protein, 16 aa, Homo sapiens
  heavy chain complementarity determining region 3 for antibody 57794
AEDGSGSYYLTEYFQH

SEQ ID NO: 115589 - protein, 9 aa, Homo sapiens
  light chain complementarity determining region 3 for antibody 57795
LQHNSYPWT

SEQ ID NO: 115590 - protein, 22 aa, Homo sapiens
  heavy chain complementarity determining region 3 for antibody 57795
ARDFPLYYDILTGYPYSHGMDV

SEQ ID NO: 115591 - protein, 9 aa, Homo sapiens
  light chain complementarity determining region 3 for antibody 57796
LQHNSYPFT

SEQ ID NO: 115592 - protein, 10 aa, Homo sapiens
  heavy chain complementarity determining region 3 for antibody 57796
ARDSSGWLDS

SEQ ID NO: 115593 - protein, 9 aa, Homo sapiens
  light chain complementarity determining region 3 for antibody 57797
LQHNSYPFT

SEQ ID NO: 115594 - protein, 10 aa, Homo sapiens
  heavy chain complementarity determining region 3 for antibody 57797
ARDSCGWLDY

SEQ ID NO: 115595 - protein, 9 aa, Homo sapiens
  light chain complementarity determining region 3 for antibody 57798
LQHNSYPFT

SEQ ID NO: 115596 - protein, 18 aa, Homo sapiens
  heavy chain complementarity determining region 3 for antibody 57798
ARDPIGYDSYYYYYGMDV

SEQ ID NO: 115597 - protein, 9 aa, Homo sapiens
  light chain complementarity determining region 3 for antibody 57799
LQHNSYPFT

SEQ ID NO: 115598 - protein, 10 aa, Homo sapiens
  heavy chain complementarity determining region 3 for antibody 57799
AGGLTYGMDV

SEQ ID NO: 115599 - protein, 9 aa, Homo sapiens
  light chain complementarity determining region 3 for antibody 57800
LQHNNYPRT

SEQ ID NO: 115600 - protein, 9 aa, Homo sapiens
  heavy chain complementarity determining region 3 for antibody 57800
AVWFGELNY

SEQ ID NO: 115601 - protein, 9 aa, Homo sapiens
  light chain complementarity determining region 3 for antibody 57801
LQHDNFPLT

SEQ ID NO: 115602 - protein, 17 aa, Homo sapiens
  heavy chain complementarity determining region 3 for antibody 57801
AREGTLFGELLPYYFDY

SEQ ID NO: 115603 - protein, 9 aa, Homo sapiens
  light chain complementarity determining region 3 for antibody 57802
LQGFNSPYT

SEQ ID NO: 115604 - protein, 20 aa, Homo sapiens
  heavy chain complementarity determining region 3 for antibody 57802
ARDRDYYGSGSYNYYYGMDV

SEQ ID NO: 115605 - protein, 9 aa, Homo sapiens
  light chain complementarity determining region 3 for antibody 57803
LQDYSYPRT

SEQ ID NO: 115606 - protein, 12 aa, Homo sapiens
  heavy chain complementarity determining region 3 for antibody 57803
ARDSFGLNWFDH

SEQ ID NO: 115607 - protein, 9 aa, Homo sapiens
  light chain complementarity determining region 3 for antibody 57804
LQDYNYPYT

SEQ ID NO: 115608 - protein, 15 aa, Homo sapiens
  heavy chain complementarity determining region 3 for antibody 57804
ARNPPVIAAAGAIDY

SEQ ID NO: 115609 - protein, 9 aa, Homo sapiens
  light chain complementarity determining region 3 for antibody 57805
LQDYNYPYT

SEQ ID NO: 115610 - protein, 18 aa, Homo sapiens
  heavy chain complementarity determining region 3 for antibody 57805
ARGAWYYYGSGSYYPFDY

SEQ ID NO: 115611 - protein, 9 aa, Homo sapiens
  light chain complementarity determining region 3 for antibody 57806
LQDYNYPWT

SEQ ID NO: 115612 - protein, 13 aa, Homo sapiens
  heavy chain complementarity determining region 3 for antibody 57806
VREYSGYDAHFDY

SEQ ID NO: 115613 - protein, 9 aa, Homo sapiens
  light chain complementarity determining region 3 for antibody 57807
LQDYNYPWT

SEQ ID NO: 115614 - protein, 11 aa, Homo sapiens
  heavy chain complementarity determining region 3 for antibody 57807
ATGPPLLWFGD

SEQ ID NO: 115615 - protein, 9 aa, Homo sapiens
  light chain complementarity determining region 3 for antibody 57808
LQDYNYPWT

SEQ ID NO: 115616 - protein, 13 aa, Homo sapiens
  heavy chain complementarity determining region 3 for antibody 57808
AGDPSPRYYGMDV

SEQ ID NO: 115617 - protein, 9 aa, Homo sapiens
  light chain complementarity determining region 3 for antibody 57809
LQDYNYPPT

SEQ ID NO: 115618 - protein, 15 aa, Homo sapiens
  heavy chain complementarity determining region 3 for antibody 57809
ARVVRYFDWLGGMDV

SEQ ID NO: 115619 - protein, 9 aa, Homo sapiens
  light chain complementarity determining region 3 for antibody 57810
LQDYNCPWT

SEQ ID NO: 115620 - protein, 13 aa, Homo sapiens
  heavy chain complementarity determining region 3 for antibody 57810
ARVRITGTYAFDI

SEQ ID NO: 115621 - protein, 9 aa, Homo sapiens
  light chain complementarity determining region 3 for antibody 57811
LQAYNYPWT

SEQ ID NO: 115622 - protein, 14 aa, Homo sapiens
  heavy chain complementarity determining region 3 for antibody 57811
AGRYYDTLTGYHDY

SEQ ID NO: 115623 - protein, 9 aa, Homo sapiens
  light chain complementarity determining region 3 for antibody 57812
HRSSSLPHT

SEQ ID NO: 115624 - protein, 13 aa, Homo sapiens
  heavy chain complementarity determining region 3 for antibody 57812
ARGGYYGSGSLDY

SEQ ID NO: 115625 - protein, 9 aa, Homo sapiens
  light chain complementarity determining region 3 for antibody 57813
HQSSSLPYT

SEQ ID NO: 115626 - protein, 11 aa, Homo sapiens
  heavy chain complementarity determining region 3 for antibody 57813
ARDPHFFGSAS

SEQ ID NO: 115627 - protein, 9 aa, Homo sapiens
  light chain complementarity determining region 3 for antibody 57814
HQSSSLPWT

SEQ ID NO: 115628 - protein, 14 aa, Homo sapiens
  heavy chain complementarity determining region 3 for antibody 57814
ARSYYGPGSYYFDY

SEQ ID NO: 115629 - protein, 9 aa, Homo sapiens
  light chain complementarity determining region 3 for antibody 57815
HQSSSLPIT

SEQ ID NO: 115630 - protein, 17 aa, Homo sapiens
  heavy chain complementarity determining region 3 for antibody 57815
AREEDSSGWAYYWYFDL

SEQ ID NO: 115631 - protein, 9 aa, Homo sapiens
  light chain complementarity determining region 3 for antibody 57816
HQSSSLPHT

SEQ ID NO: 115632 - protein, 13 aa, Homo sapiens
  heavy chain complementarity determining region 3 for antibody 57816
ARGGYYGSGSLDH

SEQ ID NO: 115633 - protein, 9 aa, Homo sapiens
  light chain complementarity determining region 3 for antibody 57817
HQSSSLPHT

SEQ ID NO: 115634 - protein, 13 aa, Homo sapiens
  heavy chain complementarity determining region 3 for antibody 57817
ARGGYYGSESLDY

SEQ ID NO: 115635 - protein, 9 aa, Homo sapiens
  light chain complementarity determining region 3 for antibody 57818
HQSSSLPHT

SEQ ID NO: 115636 - protein, 13 aa, Homo sapiens
  heavy chain complementarity determining region 3 for antibody 57818
ARGGDYGSGGLDY

SEQ ID NO: 115637 - protein, 9 aa, Homo sapiens
  light chain complementarity determining region 3 for antibody 57819
HQSSSLPHT

SEQ ID NO: 115638 - protein, 13 aa, Homo sapiens
  heavy chain complementarity determining region 3 for antibody 57819
ARGGCYGSGGLDY

SEQ ID NO: 115639 - protein, 9 aa, Homo sapiens
  light chain complementarity determining region 3 for antibody 57820
HQSSSFPHT

SEQ ID NO: 115640 - protein, 13 aa, Homo sapiens
  heavy chain complementarity determining region 3 for antibody 57820
ARGGYYGSGSLDY

SEQ ID NO: 115641 - protein, 9 aa, Homo sapiens
  light chain complementarity determining region 3 for antibody 57821
YQSSSLPHT

SEQ ID NO: 115642 - protein, 13 aa, Homo sapiens
  heavy chain complementarity determining region 3 for antibody 57821
ARGGYYGSGSLDY

SEQ ID NO: 115643 - protein, 9 aa, Homo sapiens
  light chain complementarity determining region 3 for antibody 57822
RQLNSYPLT

SEQ ID NO: 115644 - protein, 15 aa, Homo sapiens
  heavy chain complementarity determining region 3 for antibody 57822
ARDGGYSGYPIGKDV

SEQ ID NO: 115645 - protein, 9 aa, Homo sapiens
  light chain complementarity determining region 3 for antibody 57823
QQYYSYPYT

SEQ ID NO: 115646 - protein, 15 aa, Homo sapiens
  heavy chain complementarity determining region 3 for antibody 57823
ARGVLRYFGLEAFAF

SEQ ID NO: 115647 - protein, 9 aa, Homo sapiens
  light chain complementarity determining region 3 for antibody 57824
QQYNSYSLT

SEQ ID NO: 115648 - protein, 13 aa, Homo sapiens
  heavy chain complementarity determining region 3 for antibody 57824
AKRRGSGSSQFDY

SEQ ID NO: 115649 - protein, 9 aa, Homo sapiens
  light chain complementarity determining region 3 for antibody 57825
QQYNSYPRT

SEQ ID NO: 115650 - protein, 21 aa, Homo sapiens
  heavy chain complementarity determining region 3 for antibody 57825
ARETEYDILTGPYYNYYTMDV

SEQ ID NO: 115651 - protein, 9 aa, Homo sapiens
  light chain complementarity determining region 3 for antibody 57826
QQYNSYPRT

SEQ ID NO: 115652 - protein, 9 aa, Homo sapiens
  heavy chain complementarity determining region 3 for antibody 57826
ARDLSSSDV

SEQ ID NO: 115653 - protein, 9 aa, Homo sapiens
  light chain complementarity determining region 3 for antibody 57827
QQYNSYPPT

SEQ ID NO: 115654 - protein, 14 aa, Homo sapiens
  heavy chain complementarity determining region 3 for antibody 57827
ARDHSGSYFNRFDP

SEQ ID NO: 115655 - protein, 9 aa, Homo sapiens
  light chain complementarity determining region 3 for antibody 57828
QQYNSYPPT

SEQ ID NO: 115656 - protein, 14 aa, Homo sapiens
  heavy chain complementarity determining region 3 for antibody 57828
ARDHSGSYFNGFDP

SEQ ID NO: 115657 - protein, 9 aa, Homo sapiens
  light chain complementarity determining region 3 for antibody 57829
QQYNSYPLT

SEQ ID NO: 115658 - protein, 9 aa, Homo sapiens
  heavy chain complementarity determining region 3 for antibody 57829
ARGKAATGP

SEQ ID NO: 115659 - protein, 9 aa, Homo sapiens
  light chain complementarity determining region 3 for antibody 57830
QQYNSYPIT

SEQ ID NO: 115660 - protein, 10 aa, Homo sapiens
  heavy chain complementarity determining region 3 for antibody 57830
ARVVRRVFDY

SEQ ID NO: 115661 - protein, 8 aa, Homo sapiens
  light chain complementarity determining region 3 for antibody 57831
QQYNNYWT

SEQ ID NO: 115662 - protein, 18 aa, Homo sapiens
  heavy chain complementarity determining region 3 for antibody 57831
AKEGYSGSYYYYYYGMDV

SEQ ID NO: 115663 - protein, 9 aa, Homo sapiens
  light chain complementarity determining region 3 for antibody 57832
QQYNNWPYT

SEQ ID NO: 115664 - protein, 12 aa, Homo sapiens
  heavy chain complementarity determining region 3 for antibody 57832
ARGFGSTPFFDY

SEQ ID NO: 115665 - protein, 9 aa, Homo sapiens
  light chain complementarity determining region 3 for antibody 57833
QQYGSSPYT

SEQ ID NO: 115666 - protein, 20 aa, Homo sapiens
  heavy chain complementarity determining region 3 for antibody 57833
AREQVLWFGDLPYYYYGMDV

SEQ ID NO: 115667 - protein, 9 aa, Homo sapiens
  light chain complementarity determining region 3 for antibody 57834
QQWTSNPLT

SEQ ID NO: 115668 - protein, 9 aa, Homo sapiens
  heavy chain complementarity determining region 3 for antibody 57834
ARYDYDFDY

SEQ ID NO: 115669 - protein, 9 aa, Homo sapiens
  light chain complementarity determining region 3 for antibody 57835
QQRSNWPRT

SEQ ID NO: 115670 - protein, 13 aa, Homo sapiens
  heavy chain complementarity determining region 3 for antibody 57835
ATVLLWFGELFDY

SEQ ID NO: 115671 - protein, 9 aa, Homo sapiens
  light chain complementarity determining region 3 for antibody 57836
QQLNTYPYT

SEQ ID NO: 115672 - protein, 11 aa, Homo sapiens
  heavy chain complementarity determining region 3 for antibody 57836
ARIGGTYSFDY

SEQ ID NO: 115673 - protein, 9 aa, Homo sapiens
  light chain complementarity determining region 3 for antibody 57837
QQLNTYPLT

SEQ ID NO: 115674 - protein, 9 aa, Homo sapiens
  heavy chain complementarity determining region 3 for antibody 57837
ARKKGAFDY

SEQ ID NO: 115675 - protein, 9 aa, Homo sapiens
  light chain complementarity determining region 3 for antibody 57838
QQLNTYPLT

SEQ ID NO: 115676 - protein, 26 aa, Homo sapiens
  heavy chain complementarity determining region 3 for antibody 57838
ARGPTSTTYYYGSGSYYLYYYYGMDV

SEQ ID NO: 115677 - protein, 9 aa, Homo sapiens
  light chain complementarity determining region 3 for antibody 57839
QQLNSYPYT

SEQ ID NO: 115678 - protein, 15 aa, Homo sapiens
  heavy chain complementarity determining region 3 for antibody 57839
ARHYDILTGYGGFDH

SEQ ID NO: 115679 - protein, 9 aa, Homo sapiens
  light chain complementarity determining region 3 for antibody 57840
QQLNSYPWT

SEQ ID NO: 115680 - protein, 17 aa, Homo sapiens
  heavy chain complementarity determining region 3 for antibody 57840
ARGYGAGSYYNYYGMDV

SEQ ID NO: 115681 - protein, 9 aa, Homo sapiens
  light chain complementarity determining region 3 for antibody 57841
QQLNSYPRT

SEQ ID NO: 115682 - protein, 8 aa, Homo sapiens
  heavy chain complementarity determining region 3 for antibody 57841
ARGGSFDP

SEQ ID NO: 115683 - protein, 9 aa, Homo sapiens
  light chain complementarity determining region 3 for antibody 57842
QQLNSYPRT

SEQ ID NO: 115684 - protein, 11 aa, Homo sapiens
  heavy chain complementarity determining region 3 for antibody 57842
ARERRYYGMDV

SEQ ID NO: 115685 - protein, 9 aa, Homo sapiens
  light chain complementarity determining region 3 for antibody 57843
QQLNSYPRT

SEQ ID NO: 115686 - protein, 11 aa, Homo sapiens
  heavy chain complementarity determining region 3 for antibody 57843
ARDRRYYGMAV

SEQ ID NO: 115687 - protein, 9 aa, Homo sapiens
  light chain complementarity determining region 3 for antibody 57844
QQLNSYPPT

SEQ ID NO: 115688 - protein, 13 aa, Homo sapiens
  heavy chain complementarity determining region 3 for antibody 57844
ARSLLTSYSPFDY

SEQ ID NO: 115689 - protein, 9 aa, Homo sapiens
  light chain complementarity determining region 3 for antibody 57845
QQLNSYPPT

SEQ ID NO: 115690 - protein, 17 aa, Homo sapiens
  heavy chain complementarity determining region 3 for antibody 57845
ARDPLYSYGAGSSGMDV

SEQ ID NO: 115691 - protein, 9 aa, Homo sapiens
  light chain complementarity determining region 3 for antibody 57846
QQLNSYPPT

SEQ ID NO: 115692 - protein, 17 aa, Homo sapiens
  heavy chain complementarity determining region 3 for antibody 57846
AGDPLYYYGAGSSGMDV

SEQ ID NO: 115693 - protein, 9 aa, Homo sapiens
  light chain complementarity determining region 3 for antibody 57847
QQLNSYPLT

SEQ ID NO: 115694 - protein, 12 aa, Homo sapiens
  heavy chain complementarity determining region 3 for antibody 57847
ARMVRGVVPFDY

SEQ ID NO: 115695 - protein, 9 aa, Homo sapiens
  light chain complementarity determining region 3 for antibody 57848
QQLNSYPLT

SEQ ID NO: 115696 - protein, 12 aa, Homo sapiens
  heavy chain complementarity determining region 3 for antibody 57848
ARMVRGGIPFDY

SEQ ID NO: 115697 - protein, 9 aa, Homo sapiens
  light chain complementarity determining region 3 for antibody 57849
QQLNSSPCT

SEQ ID NO: 115698 - protein, 10 aa, Homo sapiens
  heavy chain complementarity determining region 3 for antibody 57849
ASGGSYYGDN

SEQ ID NO: 115699 - protein, 9 aa, Homo sapiens
  light chain complementarity determining region 3 for antibody 57850
QQLNGYPLT

SEQ ID NO: 115700 - protein, 12 aa, Homo sapiens
  heavy chain complementarity determining region 3 for antibody 57850
ARMVRGVIPFDY

SEQ ID NO: 115701 - protein, 9 aa, Homo sapiens
  light chain complementarity determining region 3 for antibody 57851
QQFYNYPRT

SEQ ID NO: 115702 - protein, 12 aa, Homo sapiens
  heavy chain complementarity determining region 3 for antibody 57851
ARDRGIGGGMDV

SEQ ID NO: 115703 - protein, 9 aa, Homo sapiens
  light chain complementarity determining region 3 for antibody 57852
QQFYNYPHT

SEQ ID NO: 115704 - protein, 13 aa, Homo sapiens
  heavy chain complementarity determining region 3 for antibody 57852
GRFLEGIGGAFDV

SEQ ID NO: 115705 - protein, 9 aa, Homo sapiens
  light chain complementarity determining region 3 for antibody 57853
QQFNNYPYT

SEQ ID NO: 115706 - protein, 17 aa, Homo sapiens
  heavy chain complementarity determining region 3 for antibody 57853
AREGYCYGSGSYYTFDY

SEQ ID NO: 115707 - protein, 9 aa, Homo sapiens
  light chain complementarity determining region 3 for antibody 57854
QQFNNYPHT

SEQ ID NO: 115708 - protein, 18 aa, Homo sapiens
  heavy chain complementarity determining region 3 for antibody 57854
AGVWFGELPYYYYYGMDV

SEQ ID NO: 115709 - protein, 9 aa, Homo sapiens
  light chain complementarity determining region 3 for antibody 57855
QQFNNYILT

SEQ ID NO: 115710 - protein, 22 aa, Homo sapiens
  heavy chain complementarity determining region 3 for antibody 57855
ARDRHYYGSGSYSYYYYYGMDV

SEQ ID NO: 115711 - protein, 9 aa, Homo sapiens
  light chain complementarity determining region 3 for antibody 57856
QQFNIYPYT

SEQ ID NO: 115712 - protein, 14 aa, Homo sapiens
  heavy chain complementarity determining region 3 for antibody 57856
ARRFRIAVAAPIDY

SEQ ID NO: 115713 - protein, 8 aa, Homo sapiens
  light chain complementarity determining region 3 for antibody 57857
QQDYSLFT

SEQ ID NO: 115714 - protein, 14 aa, Homo sapiens
  heavy chain complementarity determining region 3 for antibody 57857
AKQGSGKFGYGMDV

SEQ ID NO: 115715 - protein, 9 aa, Homo sapiens
  light chain complementarity determining region 3 for antibody 57858
QQCYSTPRT

SEQ ID NO: 115716 - protein, 20 aa, Homo sapiens
  heavy chain complementarity determining region 3 for antibody 57858
AGDAGVWFVDPYYYYNGMDV

SEQ ID NO: 115717 - protein, 9 aa, Homo sapiens
  light chain complementarity determining region 3 for antibody 57859
QQCNSAPWT

SEQ ID NO: 115718 - protein, 15 aa, Homo sapiens
  heavy chain complementarity determining region 3 for antibody 57859
AKAGDYYGSGSPFDY

SEQ ID NO: 115719 - protein, 9 aa, Homo sapiens
  light chain complementarity determining region 3 for antibody 57860
QKYSSAPWT

SEQ ID NO: 115720 - protein, 15 aa, Homo sapiens
  heavy chain complementarity determining region 3 for antibody 57860
AKAGDYYGSGSPFDY

SEQ ID NO: 115721 - protein, 9 aa, Homo sapiens
  light chain complementarity determining region 3 for antibody 57861
QKYNSTPWT

SEQ ID NO: 115722 - protein, 15 aa, Homo sapiens
  heavy chain complementarity determining region 3 for antibody 57861
AKAGDYYGSGSPFDY

SEQ ID NO: 115723 - protein, 9 aa, Homo sapiens
  light chain complementarity determining region 3 for antibody 57862
QKYNSAPWT

SEQ ID NO: 115724 - protein, 12 aa, Homo sapiens
  heavy chain complementarity determining region 3 for antibody 57862
AKDRSYYYGMDV

SEQ ID NO: 115725 - protein, 9 aa, Homo sapiens
  light chain complementarity determining region 3 for antibody 57863
QKYNSAPWT

SEQ ID NO: 115726 - protein, 15 aa, Homo sapiens
  heavy chain complementarity determining region 3 for antibody 57863
AKAGDYYGSSSPFDY

SEQ ID NO: 115727 - protein, 9 aa, Homo sapiens
  light chain complementarity determining region 3 for antibody 57864
QKYNSAPWT

SEQ ID NO: 115728 - protein, 15 aa, Homo sapiens
  heavy chain complementarity determining region 3 for antibody 57864
AKAGDYYGSGSSFDY

SEQ ID NO: 115729 - protein, 9 aa, Homo sapiens
  light chain complementarity determining region 3 for antibody 57865
QKYNSAPWT

SEQ ID NO: 115730 - protein, 15 aa, Homo sapiens
  heavy chain complementarity determining region 3 for antibody 57865
AKAGDYYDSGSPFDY

SEQ ID NO: 115731 - protein, 9 aa, Homo sapiens
  light chain complementarity determining region 3 for antibody 57866
QKYNSAPWT

SEQ ID NO: 115732 - protein, 15 aa, Homo sapiens
  heavy chain complementarity determining region 3 for antibody 57866
AKAGDYYCSGSPFDY

SEQ ID NO: 115733 - protein, 9 aa, Homo sapiens
  light chain complementarity determining region 3 for antibody 57867
QKYNSAPWT

SEQ ID NO: 115734 - protein, 15 aa, Homo sapiens
  heavy chain complementarity determining region 3 for antibody 57867
AKAGDYSGSGSPFDY

SEQ ID NO: 115735 - protein, 9 aa, Homo sapiens
  light chain complementarity determining region 3 for antibody 57868
QKYNSAPWT

SEQ ID NO: 115736 - protein, 15 aa, Homo sapiens
  heavy chain complementarity determining region 3 for antibody 57868
AEAGDYYGSGSAFDY

SEQ ID NO: 115737 - protein, 9 aa, Homo sapiens
  light chain complementarity determining region 3 for antibody 57869
QKYNSAPGT

SEQ ID NO: 115738 - protein, 15 aa, Homo sapiens
  heavy chain complementarity determining region 3 for antibody 57869
AKAGDYYGSGSPFDY

SEQ ID NO: 115739 - protein, 9 aa, Homo sapiens
  light chain complementarity determining region 3 for antibody 57870
QKYNNAPWT

SEQ ID NO: 115740 - protein, 15 aa, Homo sapiens
  heavy chain complementarity determining region 3 for antibody 57870
AKAGDYYGSGSPFDY

SEQ ID NO: 115741 - protein, 9 aa, Homo sapiens
  light chain complementarity determining region 3 for antibody 57871
QKYNGAPWT

SEQ ID NO: 115742 - protein, 15 aa, Homo sapiens
  heavy chain complementarity determining region 3 for antibody 57871
AKAGDYYGSGSPFDY

SEQ ID NO: 115743 - protein, 9 aa, Homo sapiens
  light chain complementarity determining region 3 for antibody 57872
LQHNSYPYT

SEQ ID NO: 115744 - protein, 12 aa, Homo sapiens
  heavy chain complementarity determining region 3 for antibody 57872
AKDSSYYYGMDV

SEQ ID NO: 115745 - protein, 9 aa, Homo sapiens
  light chain complementarity determining region 3 for antibody 57873
LQHNSYPYT

SEQ ID NO: 115746 - protein, 12 aa, Homo sapiens
  heavy chain complementarity determining region 3 for antibody 57873
AKDRSYYYGVDV

SEQ ID NO: 115747 - protein, 9 aa, Homo sapiens
  light chain complementarity determining region 3 for antibody 57874
LQHNSYPYT

SEQ ID NO: 115748 - protein, 12 aa, Homo sapiens
  heavy chain complementarity determining region 3 for antibody 57874
AKDRNYYYGMDV

SEQ ID NO: 115749 - protein, 9 aa, Homo sapiens
  light chain complementarity determining region 3 for antibody 57875
LQHNSYPWT

SEQ ID NO: 115750 - protein, 23 aa, Homo sapiens
  heavy chain complementarity determining region 3 for antibody 57875
ATGDDYVWGSYRYTNYYSYGMDV

SEQ ID NO: 115751 - protein, 9 aa, Homo sapiens
  light chain complementarity determining region 3 for antibody 57876
LQHNSYPWT

SEQ ID NO: 115752 - protein, 13 aa, Homo sapiens
  heavy chain complementarity determining region 3 for antibody 57876
AREGDIVAKAFDY

SEQ ID NO: 115753 - protein, 9 aa, Homo sapiens
  light chain complementarity determining region 3 for antibody 57877
LQHNSYPWT

SEQ ID NO: 115754 - protein, 22 aa, Homo sapiens
  heavy chain complementarity determining region 3 for antibody 57877
ARDFPLYYDIVTGYPYYHGMDV

SEQ ID NO: 115755 - protein, 9 aa, Homo sapiens
  light chain complementarity determining region 3 for antibody 57878
LQHNSYPWT

SEQ ID NO: 115756 - protein, 17 aa, Homo sapiens
  heavy chain complementarity determining region 3 for antibody 57878
AGDDYGDYGYYYYGMDV

SEQ ID NO: 115757 - protein, 9 aa, Homo sapiens
  light chain complementarity determining region 3 for antibody 57879
LQHNSYPRT

SEQ ID NO: 115758 - protein, 18 aa, Homo sapiens
  heavy chain complementarity determining region 3 for antibody 57879
ATPITGTTGYYYSYGMDV

SEQ ID NO: 115759 - protein, 9 aa, Homo sapiens
  light chain complementarity determining region 3 for antibody 57880
LQHNSYPFT

SEQ ID NO: 115760 - protein, 10 aa, Homo sapiens
  heavy chain complementarity determining region 3 for antibody 57880
ARDGSGWLDY

SEQ ID NO: 115761 - protein, 9 aa, Homo sapiens
  light chain complementarity determining region 3 for antibody 57881
LQHNSFPPT

SEQ ID NO: 115762 - protein, 19 aa, Homo sapiens
  heavy chain complementarity determining region 3 for antibody 57881
AREGISMVRGAIYYFGMDI

SEQ ID NO: 115763 - protein, 9 aa, Homo sapiens
  light chain complementarity determining region 3 for antibody 57882
LQDYSYPWM

SEQ ID NO: 115764 - protein, 10 aa, Homo sapiens
  heavy chain complementarity determining region 3 for antibody 57882
ATMTNVTFDY

SEQ ID NO: 115765 - protein, 9 aa, Homo sapiens
  light chain complementarity determining region 3 for antibody 57883
LQDYSFPWT

SEQ ID NO: 115766 - protein, 12 aa, Homo sapiens
  heavy chain complementarity determining region 3 for antibody 57883
ARAPVAGSSFVY

SEQ ID NO: 115767 - protein, 9 aa, Homo sapiens
  light chain complementarity determining region 3 for antibody 57884
LQDYNYPYT

SEQ ID NO: 115768 - protein, 15 aa, Homo sapiens
  heavy chain complementarity determining region 3 for antibody 57884
ARNRNTATAPDAFDI

SEQ ID NO: 115769 - protein, 9 aa, Homo sapiens
  light chain complementarity determining region 3 for antibody 57885
LQDYNYPYT

SEQ ID NO: 115770 - protein, 15 aa, Homo sapiens
  heavy chain complementarity determining region 3 for antibody 57885
ARNPPVIAAAGTIDH

SEQ ID NO: 115771 - protein, 9 aa, Homo sapiens
  light chain complementarity determining region 3 for antibody 57886
LQDYNYPYT

SEQ ID NO: 115772 - protein, 17 aa, Homo sapiens
  heavy chain complementarity determining region 3 for antibody 57886
ARGGVRGVIIVYYGMDV

SEQ ID NO: 115773 - protein, 9 aa, Homo sapiens
  light chain complementarity determining region 3 for antibody 57887
LQDYNYPYT

SEQ ID NO: 115774 - protein, 18 aa, Homo sapiens
  heavy chain complementarity determining region 3 for antibody 57887
ARGAWYDYGSGSYYTFDY

SEQ ID NO: 115775 - protein, 9 aa, Homo sapiens
  light chain complementarity determining region 3 for antibody 57888
LQDYNYPYT

SEQ ID NO: 115776 - protein, 22 aa, Homo sapiens
  heavy chain complementarity determining region 3 for antibody 57888
ARDVRDYDDLAGYYNGGNYFDY

SEQ ID NO: 115777 - protein, 9 aa, Homo sapiens
  light chain complementarity determining region 3 for antibody 57889
LQDYNYPYT

SEQ ID NO: 115778 - protein, 15 aa, Homo sapiens
  heavy chain complementarity determining region 3 for antibody 57889
AKEGKLRYVDWLGDY

SEQ ID NO: 115779 - protein, 9 aa, Homo sapiens
  light chain complementarity determining region 3 for antibody 57890
LQDYNYPYT

SEQ ID NO: 115780 - protein, 15 aa, Homo sapiens
  heavy chain complementarity determining region 3 for antibody 57890
AKEGKLRYFDWLRDY

SEQ ID NO: 115781 - protein, 9 aa, Homo sapiens
  light chain complementarity determining region 3 for antibody 57891
LQDYNYPYT

SEQ ID NO: 115782 - protein, 18 aa, Homo sapiens
  heavy chain complementarity determining region 3 for antibody 57891
AGGAWYYYGSGSYYTFDY

SEQ ID NO: 115783 - protein, 9 aa, Homo sapiens
  light chain complementarity determining region 3 for antibody 57892
LQDYNYPWT

SEQ ID NO: 115784 - protein, 11 aa, Homo sapiens
  heavy chain complementarity determining region 3 for antibody 57892
ATGSPLLWFGY

SEQ ID NO: 115785 - protein, 9 aa, Homo sapiens
  light chain complementarity determining region 3 for antibody 57893
LQDYNYPWT

SEQ ID NO: 115786 - protein, 11 aa, Homo sapiens
  heavy chain complementarity determining region 3 for antibody 57893
ASGSPLLWFGD

SEQ ID NO: 115787 - protein, 9 aa, Homo sapiens
  light chain complementarity determining region 3 for antibody 57894
LQDYNYPWT

SEQ ID NO: 115788 - protein, 14 aa, Homo sapiens
  heavy chain complementarity determining region 3 for antibody 57894
ARGLLWFGGYGVDV

SEQ ID NO: 115789 - protein, 9 aa, Homo sapiens
  light chain complementarity determining region 3 for antibody 57895
LQDYNYPWT

SEQ ID NO: 115790 - protein, 14 aa, Homo sapiens
  heavy chain complementarity determining region 3 for antibody 57895
ARGLLWCGGYGLDV

SEQ ID NO: 115791 - protein, 9 aa, Homo sapiens
  light chain complementarity determining region 3 for antibody 57896
LQDYNYPWT

SEQ ID NO: 115792 - protein, 13 aa, Homo sapiens
  heavy chain complementarity determining region 3 for antibody 57896
AREYSGYDAPFDY

SEQ ID NO: 115793 - protein, 9 aa, Homo sapiens
  light chain complementarity determining region 3 for antibody 57897
LQDYNYPWT

SEQ ID NO: 115794 - protein, 13 aa, Homo sapiens
  heavy chain complementarity determining region 3 for antibody 57897
AGVRITGTYAFDI

SEQ ID NO: 115795 - protein, 9 aa, Homo sapiens
  light chain complementarity determining region 3 for antibody 57898
LQDYNYPWM

SEQ ID NO: 115796 - protein, 14 aa, Homo sapiens
  heavy chain complementarity determining region 3 for antibody 57898
AGRHYDILTGFSDY

SEQ ID NO: 115797 - protein, 9 aa, Homo sapiens
  light chain complementarity determining region 3 for antibody 57899
LQDYNYPWA

SEQ ID NO: 115798 - protein, 12 aa, Homo sapiens
  heavy chain complementarity determining region 3 for antibody 57899
ARLVGAWSGMDV

SEQ ID NO: 115799 - protein, 9 aa, Homo sapiens
  light chain complementarity determining region 3 for antibody 57900
LQDYNYPLT

SEQ ID NO: 115800 - protein, 10 aa, Homo sapiens
  heavy chain complementarity determining region 3 for antibody 57900
VRMTTVVFDY

SEQ ID NO: 115801 - protein, 9 aa, Homo sapiens
  light chain complementarity determining region 3 for antibody 57901
LQDYNYLRT

SEQ ID NO: 115802 - protein, 14 aa, Homo sapiens
  heavy chain complementarity determining region 3 for antibody 57901
ARWDSSSWYDTFDI

SEQ ID NO: 115803 - protein, 8 aa, Homo sapiens
  light chain complementarity determining region 3 for antibody 57902
LQDYNFYT

SEQ ID NO: 115804 - protein, 9 aa, Homo sapiens
  heavy chain complementarity determining region 3 for antibody 57902
ARDREFFDY

SEQ ID NO: 115805 - protein, 9 aa, Homo sapiens
  light chain complementarity determining region 3 for antibody 57903
LQAYNYPWT

SEQ ID NO: 115806 - protein, 14 aa, Homo sapiens
  heavy chain complementarity determining region 3 for antibody 57903
AGRYYDILSGYHDY

SEQ ID NO: 115807 - protein, 9 aa, Homo sapiens
  light chain complementarity determining region 3 for antibody 57904
IQDYNYPWT

SEQ ID NO: 115808 - protein, 11 aa, Homo sapiens
  heavy chain complementarity determining region 3 for antibody 57904
ATGSPLLWFGD

SEQ ID NO: 115809 - protein, 9 aa, Homo sapiens
  light chain complementarity determining region 3 for antibody 57905
HQSSSSPHT

SEQ ID NO: 115810 - protein, 13 aa, Homo sapiens
  heavy chain complementarity determining region 3 for antibody 57905
ARGGYYGSGSLDY

SEQ ID NO: 115811 - protein, 9 aa, Homo sapiens
  light chain complementarity determining region 3 for antibody 57906
HQSSSLTHT

SEQ ID NO: 115812 - protein, 13 aa, Homo sapiens
  heavy chain complementarity determining region 3 for antibody 57906
ARGGYYGSGSLDY

SEQ ID NO: 115813 - protein, 9 aa, Homo sapiens
  light chain complementarity determining region 3 for antibody 57907
HQSSSLPYT

SEQ ID NO: 115814 - protein, 13 aa, Homo sapiens
  heavy chain complementarity determining region 3 for antibody 57907
AGHSGSYGRYFDY

SEQ ID NO: 115815 - protein, 9 aa, Homo sapiens
  light chain complementarity determining region 3 for antibody 57908
HQSSSLPLT

SEQ ID NO: 115816 - protein, 13 aa, Homo sapiens
  heavy chain complementarity determining region 3 for antibody 57908
ARGGYYGSESLDY

SEQ ID NO: 115817 - protein, 9 aa, Homo sapiens
  light chain complementarity determining region 3 for antibody 57909
HQSSSLPHT

SEQ ID NO: 115818 - protein, 13 aa, Homo sapiens
  heavy chain complementarity determining region 3 for antibody 57909
ERGGYYGSGSLDY

SEQ ID NO: 115819 - protein, 9 aa, Homo sapiens
  light chain complementarity determining region 3 for antibody 57910
HQSSSLPHT

SEQ ID NO: 115820 - protein, 8 aa, Homo sapiens
  heavy chain complementarity determining region 3 for antibody 57910
ARNWGFDY

SEQ ID NO: 115821 - protein, 9 aa, Homo sapiens
  light chain complementarity determining region 3 for antibody 57911
HQSSSLPHT

SEQ ID NO: 115822 - protein, 13 aa, Homo sapiens
  heavy chain complementarity determining region 3 for antibody 57911
ARGGYYGSGTLDY

SEQ ID NO: 115823 - protein, 9 aa, Homo sapiens
  light chain complementarity determining region 3 for antibody 57912
HQSSSLPHT

SEQ ID NO: 115824 - protein, 13 aa, Homo sapiens
  heavy chain complementarity determining region 3 for antibody 57912
ARGGYYGSGSRDY

SEQ ID NO: 115825 - protein, 9 aa, Homo sapiens
  light chain complementarity determining region 3 for antibody 57913
HQSSSLPHT

SEQ ID NO: 115826 - protein, 13 aa, Homo sapiens
  heavy chain complementarity determining region 3 for antibody 57913
ARGGYYGSGNLDY

SEQ ID NO: 115827 - protein, 9 aa, Homo sapiens
  light chain complementarity determining region 3 for antibody 57914
HQSSSLPHT

SEQ ID NO: 115828 - protein, 13 aa, Homo sapiens
  heavy chain complementarity determining region 3 for antibody 57914
ARGGDYGSGSIDY

SEQ ID NO: 115829 - protein, 9 aa, Homo sapiens
  light chain complementarity determining region 3 for antibody 57915
HQSSSLPHT

SEQ ID NO: 115830 - protein, 13 aa, Homo sapiens
  heavy chain complementarity determining region 3 for antibody 57915
ARGEYYGSGSLDY

SEQ ID NO: 115831 - protein, 9 aa, Homo sapiens
  light chain complementarity determining region 3 for antibody 57916
HQSSSLPHT

SEQ ID NO: 115832 - protein, 13 aa, Homo sapiens
  heavy chain complementarity determining region 3 for antibody 57916
AREGYYGSGSLDY

SEQ ID NO: 115833 - protein, 9 aa, Homo sapiens
  light chain complementarity determining region 3 for antibody 57917
HQSSSLPHP

SEQ ID NO: 115834 - protein, 13 aa, Homo sapiens
  heavy chain complementarity determining region 3 for antibody 57917
ARGGYYGSGSLDY

SEQ ID NO: 115835 - protein, 9 aa, Homo sapiens
  light chain complementarity determining region 3 for antibody 57918
QQYNSYPYT

SEQ ID NO: 115836 - protein, 10 aa, Homo sapiens
  heavy chain complementarity determining region 3 for antibody 57918
ARSNSGDFDY

SEQ ID NO: 115837 - protein, 9 aa, Homo sapiens
  light chain complementarity determining region 3 for antibody 57919
QQYNSYPYT

SEQ ID NO: 115838 - protein, 10 aa, Homo sapiens
  heavy chain complementarity determining region 3 for antibody 57919
ARSNCGDFDY

SEQ ID NO: 115839 - protein, 9 aa, Homo sapiens
  light chain complementarity determining region 3 for antibody 57920
QQYNSYPYT

SEQ ID NO: 115840 - protein, 17 aa, Homo sapiens
  heavy chain complementarity determining region 3 for antibody 57920
ARLVLRYSDWLLPHFDY

SEQ ID NO: 115841 - protein, 9 aa, Homo sapiens
  light chain complementarity determining region 3 for antibody 57921
QQYNSYPYT

SEQ ID NO: 115842 - protein, 12 aa, Homo sapiens
  heavy chain complementarity determining region 3 for antibody 57921
AREAAAGNWFDH

SEQ ID NO: 115843 - protein, 9 aa, Homo sapiens
  light chain complementarity determining region 3 for antibody 57922
QQYNSYPYT

SEQ ID NO: 115844 - protein, 12 aa, Homo sapiens
  heavy chain complementarity determining region 3 for antibody 57922
AREAAAGNCFDP

SEQ ID NO: 115845 - protein, 9 aa, Homo sapiens
  light chain complementarity determining region 3 for antibody 57923
QQYNSYPRT

SEQ ID NO: 115846 - protein, 21 aa, Homo sapiens
  heavy chain complementarity determining region 3 for antibody 57923
ARETDYDSLTGPYYNYYTMDV

SEQ ID NO: 115847 - protein, 9 aa, Homo sapiens
  light chain complementarity determining region 3 for antibody 57924
QQYNSYPRT

SEQ ID NO: 115848 - protein, 21 aa, Homo sapiens
  heavy chain complementarity determining region 3 for antibody 57924
ARETDYDILAGPYYNYYTMDV

SEQ ID NO: 115849 - protein, 9 aa, Homo sapiens
  light chain complementarity determining region 3 for antibody 57925
QQYNSYPPT

SEQ ID NO: 115850 - protein, 14 aa, Homo sapiens
  heavy chain complementarity determining region 3 for antibody 57925
ARDHSGSYCNWFDP

SEQ ID NO: 115851 - protein, 9 aa, Homo sapiens
  light chain complementarity determining region 3 for antibody 57926
QQYNSYPLT

SEQ ID NO: 115852 - protein, 11 aa, Homo sapiens
  heavy chain complementarity determining region 3 for antibody 57926
ARGRGAAASDY

SEQ ID NO: 115853 - protein, 9 aa, Homo sapiens
  light chain complementarity determining region 3 for antibody 57927
QQYNSYPLT

SEQ ID NO: 115854 - protein, 17 aa, Homo sapiens
  heavy chain complementarity determining region 3 for antibody 57927
ARDRIAMVRGVYNWFDP

SEQ ID NO: 115855 - protein, 9 aa, Homo sapiens
  light chain complementarity determining region 3 for antibody 57928
QQYNSYPLT

SEQ ID NO: 115856 - protein, 9 aa, Homo sapiens
  heavy chain complementarity determining region 3 for antibody 57928
AIASADPDY

SEQ ID NO: 115857 - protein, 9 aa, Homo sapiens
  light chain complementarity determining region 3 for antibody 57929
QQYNSYPLT

SEQ ID NO: 115858 - protein, 9 aa, Homo sapiens
  heavy chain complementarity determining region 3 for antibody 57929
AIAAADHDY

SEQ ID NO: 115859 - protein, 9 aa, Homo sapiens
  light chain complementarity determining region 3 for antibody 57930
QQYNNWPYT

SEQ ID NO: 115860 - protein, 17 aa, Homo sapiens
  heavy chain complementarity determining region 3 for antibody 57930
ARDLTMVRGVTSYGMDV

SEQ ID NO: 115861 - protein, 9 aa, Homo sapiens
  light chain complementarity determining region 3 for antibody 57931
QQYNNWPLT

SEQ ID NO: 115862 - protein, 18 aa, Homo sapiens
  heavy chain complementarity determining region 3 for antibody 57931
TRDRRPPGIAVAEGAFDI

SEQ ID NO: 115863 - protein, 9 aa, Homo sapiens
  light chain complementarity determining region 3 for antibody 57932
QQYNNWPLT

SEQ ID NO: 115864 - protein, 18 aa, Homo sapiens
  heavy chain complementarity determining region 3 for antibody 57932
TRDLRPPGIAVAEGAFDL

SEQ ID NO: 115865 - protein, 9 aa, Homo sapiens
  light chain complementarity determining region 3 for antibody 57933
QQYNNWPLT

SEQ ID NO: 115866 - protein, 12 aa, Homo sapiens
  heavy chain complementarity determining region 3 for antibody 57933
AKDLYTYGHFDY

SEQ ID NO: 115867 - protein, 9 aa, Homo sapiens
  light chain complementarity determining region 3 for antibody 57934
QQYHNWPYT

SEQ ID NO: 115868 - protein, 17 aa, Homo sapiens
  heavy chain complementarity determining region 3 for antibody 57934
ARDITMVRGVNHYGMDV

SEQ ID NO: 115869 - protein, 7 aa, Homo sapiens
  light chain complementarity determining region 3 for antibody 57935
QQYGSWT

SEQ ID NO: 115870 - protein, 16 aa, Homo sapiens
  heavy chain complementarity determining region 3 for antibody 57935
ARGSVDTVNDYYGMDV

SEQ ID NO: 115871 - protein, 9 aa, Homo sapiens
  light chain complementarity determining region 3 for antibody 57936
QQYGSSPYT

SEQ ID NO: 115872 - protein, 16 aa, Homo sapiens
  heavy chain complementarity determining region 3 for antibody 57936
ARSLLRYFAFRNYFDY

SEQ ID NO: 115873 - protein, 9 aa, Homo sapiens
  light chain complementarity determining region 3 for antibody 57937
QQYGSSPWT

SEQ ID NO: 115874 - protein, 10 aa, Homo sapiens
  heavy chain complementarity determining region 3 for antibody 57937
ARGVRGVKDH

SEQ ID NO: 115875 - protein, 9 aa, Homo sapiens
  light chain complementarity determining region 3 for antibody 57938
QQYGSSPRT

SEQ ID NO: 115876 - protein, 14 aa, Homo sapiens
  heavy chain complementarity determining region 3 for antibody 57938
AKERLRYVDWFLDY

SEQ ID NO: 115877 - protein, 9 aa, Homo sapiens
  light chain complementarity determining region 3 for antibody 57939
QQYGSSPRT

SEQ ID NO: 115878 - protein, 14 aa, Homo sapiens
  heavy chain complementarity determining region 3 for antibody 57939
AKERLRYFAWFLDY

SEQ ID NO: 115879 - protein, 9 aa, Homo sapiens
  light chain complementarity determining region 3 for antibody 57940
QQYGSSPRT

SEQ ID NO: 115880 - protein, 14 aa, Homo sapiens
  heavy chain complementarity determining region 3 for antibody 57940
AEERLRYFDWFLDY

SEQ ID NO: 115881 - protein, 9 aa, Homo sapiens
  light chain complementarity determining region 3 for antibody 57941
QQYGSSPFT

SEQ ID NO: 115882 - protein, 17 aa, Homo sapiens
  heavy chain complementarity determining region 3 for antibody 57941
ARDRAVRGGYNYYGMDV

SEQ ID NO: 115883 - protein, 9 aa, Homo sapiens
  light chain complementarity determining region 3 for antibody 57942
QQSFSTPFT

SEQ ID NO: 115884 - protein, 17 aa, Homo sapiens
  heavy chain complementarity determining region 3 for antibody 57942
ARAESDWDYYYYYGMDV

SEQ ID NO: 115885 - protein, 9 aa, Homo sapiens
  light chain complementarity determining region 3 for antibody 57943
QQSFSTPFT

SEQ ID NO: 115886 - protein, 17 aa, Homo sapiens
  heavy chain complementarity determining region 3 for antibody 57943
AGAESYWDYYYYYGMDV

SEQ ID NO: 115887 - protein, 9 aa, Homo sapiens
  light chain complementarity determining region 3 for antibody 57944
QQRSNWPLT

SEQ ID NO: 115888 - protein, 5 aa, Homo sapiens
  heavy chain complementarity determining region 3 for antibody 57944
AAPDY

SEQ ID NO: 115889 - protein, 9 aa, Homo sapiens
  light chain complementarity determining region 3 for antibody 57945
QQLNSYPYT

SEQ ID NO: 115890 - protein, 15 aa, Homo sapiens
  heavy chain complementarity determining region 3 for antibody 57945
ASHYDILTGYGGFDP

SEQ ID NO: 115891 - protein, 9 aa, Homo sapiens
  light chain complementarity determining region 3 for antibody 57946
QQLNSYPYT

SEQ ID NO: 115892 - protein, 13 aa, Homo sapiens
  heavy chain complementarity determining region 3 for antibody 57946
AREGYGDQYSFDD

SEQ ID NO: 115893 - protein, 9 aa, Homo sapiens
  light chain complementarity determining region 3 for antibody 57947
QQLNSYPWT

SEQ ID NO: 115894 - protein, 13 aa, Homo sapiens
  heavy chain complementarity determining region 3 for antibody 57947
ARITMARGVSFDY

SEQ ID NO: 115895 - protein, 9 aa, Homo sapiens
  light chain complementarity determining region 3 for antibody 57948
QQLNSYPWT

SEQ ID NO: 115896 - protein, 17 aa, Homo sapiens
  heavy chain complementarity determining region 3 for antibody 57948
ARGYGSGSYYNSYGMDV

SEQ ID NO: 115897 - protein, 9 aa, Homo sapiens
  light chain complementarity determining region 3 for antibody 57949
QQLNSYPRT

SEQ ID NO: 115898 - protein, 22 aa, Homo sapiens
  heavy chain complementarity determining region 3 for antibody 57949
TKDPGGIVAKSRDYQYFYGVDV

SEQ ID NO: 115899 - protein, 9 aa, Homo sapiens
  light chain complementarity determining region 3 for antibody 57950
QQLNSYPRT

SEQ ID NO: 115900 - protein, 12 aa, Homo sapiens
  heavy chain complementarity determining region 3 for antibody 57950
AIDPYSSRGFDY

SEQ ID NO: 115901 - protein, 9 aa, Homo sapiens
  light chain complementarity determining region 3 for antibody 57951
QQLNSYPPT

SEQ ID NO: 115902 - protein, 17 aa, Homo sapiens
  heavy chain complementarity determining region 3 for antibody 57951
AREPLYYYGAGSSGMDV

SEQ ID NO: 115903 - protein, 9 aa, Homo sapiens
  light chain complementarity determining region 3 for antibody 57952
QQLNSYPLT

SEQ ID NO: 115904 - protein, 12 aa, Homo sapiens
  heavy chain complementarity determining region 3 for antibody 57952
ARRVRGVIPFDY

SEQ ID NO: 115905 - protein, 9 aa, Homo sapiens
  light chain complementarity determining region 3 for antibody 57953
QQLNSYPLT

SEQ ID NO: 115906 - protein, 12 aa, Homo sapiens
  heavy chain complementarity determining region 3 for antibody 57953
ARMVRGVIPFAY

SEQ ID NO: 115907 - protein, 9 aa, Homo sapiens
  light chain complementarity determining region 3 for antibody 57954
QQLNSYPLT

SEQ ID NO: 115908 - protein, 12 aa, Homo sapiens
  heavy chain complementarity determining region 3 for antibody 57954
ARMVLGVIPFDY

SEQ ID NO: 115909 - protein, 9 aa, Homo sapiens
  light chain complementarity determining region 3 for antibody 57955
QQLNSYPLT

SEQ ID NO: 115910 - protein, 14 aa, Homo sapiens
  heavy chain complementarity determining region 3 for antibody 57955
AREGTSSYYYGMDV

SEQ ID NO: 115911 - protein, 9 aa, Homo sapiens
  light chain complementarity determining region 3 for antibody 57956
QQLNSHPPT

SEQ ID NO: 115912 - protein, 12 aa, Homo sapiens
  heavy chain complementarity determining region 3 for antibody 57956
TFFSGTFNWFDP

SEQ ID NO: 115913 - protein, 9 aa, Homo sapiens
  light chain complementarity determining region 3 for antibody 57957
QQLNSCPRT

SEQ ID NO: 115914 - protein, 11 aa, Homo sapiens
  heavy chain complementarity determining region 3 for antibody 57957
ARDRSYYGMDV

SEQ ID NO: 115915 - protein, 9 aa, Homo sapiens
  light chain complementarity determining region 3 for antibody 57958
QQLNGYPFT

SEQ ID NO: 115916 - protein, 15 aa, Homo sapiens
  heavy chain complementarity determining region 3 for antibody 57958
ARDYYYGSGSRWFDP

SEQ ID NO: 115917 - protein, 9 aa, Homo sapiens
  light chain complementarity determining region 3 for antibody 57959
QQFYNYPRT

SEQ ID NO: 115918 - protein, 12 aa, Homo sapiens
  heavy chain complementarity determining region 3 for antibody 57959
AREWGIGGGMDV

SEQ ID NO: 115919 - protein, 9 aa, Homo sapiens
  light chain complementarity determining region 3 for antibody 57960
QQFYNYPRK

SEQ ID NO: 115920 - protein, 12 aa, Homo sapiens
  heavy chain complementarity determining region 3 for antibody 57960
ARDWGIGGGMDV

SEQ ID NO: 115921 - protein, 9 aa, Homo sapiens
  light chain complementarity determining region 3 for antibody 57961
QQFYNYPHT

SEQ ID NO: 115922 - protein, 13 aa, Homo sapiens
  heavy chain complementarity determining region 3 for antibody 57961
GRFLEGIGGAFDF

SEQ ID NO: 115923 - protein, 9 aa, Homo sapiens
  light chain complementarity determining region 3 for antibody 57962
QQFYNYPHT

SEQ ID NO: 115924 - protein, 15 aa, Homo sapiens
  heavy chain complementarity determining region 3 for antibody 57962
AKAGDYYGSGSPFDY

SEQ ID NO: 115925 - protein, 8 aa, Homo sapiens
  light chain complementarity determining region 3 for antibody 57963
QQFNSYPT

SEQ ID NO: 115926 - protein, 17 aa, Homo sapiens
  heavy chain complementarity determining region 3 for antibody 57963
ARRIIWFGELLDYGMDV

SEQ ID NO: 115927 - protein, 7 aa, Homo sapiens
  light chain complementarity determining region 3 for antibody 57964
QQFNNYT

SEQ ID NO: 115928 - protein, 22 aa, Homo sapiens
  heavy chain complementarity determining region 3 for antibody 57964
ARGGIRYFDWGYLGNYYYGMDV

SEQ ID NO: 115929 - protein, 9 aa, Homo sapiens
  light chain complementarity determining region 3 for antibody 57965
QQFNNYPYT

SEQ ID NO: 115930 - protein, 17 aa, Homo sapiens
  heavy chain complementarity determining region 3 for antibody 57965
AREGYYYGSGSYYTIDY

SEQ ID NO: 115931 - protein, 9 aa, Homo sapiens
  light chain complementarity determining region 3 for antibody 57966
QQFNNYPYT

SEQ ID NO: 115932 - protein, 17 aa, Homo sapiens
  heavy chain complementarity determining region 3 for antibody 57966
AREGYYYGSGGYYTFDY

SEQ ID NO: 115933 - protein, 9 aa, Homo sapiens
  light chain complementarity determining region 3 for antibody 57967
QQFNNYPYT

SEQ ID NO: 115934 - protein, 17 aa, Homo sapiens
  heavy chain complementarity determining region 3 for antibody 57967
AREGYYYGSASYYTFDY

SEQ ID NO: 115935 - protein, 9 aa, Homo sapiens
  light chain complementarity determining region 3 for antibody 57968
QQFNNYPYT

SEQ ID NO: 115936 - protein, 17 aa, Homo sapiens
  heavy chain complementarity determining region 3 for antibody 57968
AREGYDYGSGSYYTFDY

SEQ ID NO: 115937 - protein, 9 aa, Homo sapiens
  light chain complementarity determining region 3 for antibody 57969
QQFNNYPRT

SEQ ID NO: 115938 - protein, 17 aa, Homo sapiens
  heavy chain complementarity determining region 3 for antibody 57969
AREHVVVVTAINDAFDI

SEQ ID NO: 115939 - protein, 9 aa, Homo sapiens
  light chain complementarity determining region 3 for antibody 57970
QQFNNYPLT

SEQ ID NO: 115940 - protein, 22 aa, Homo sapiens
  heavy chain complementarity determining region 3 for antibody 57970
AKQSHYYESESYRHYYYYGMDV

SEQ ID NO: 115941 - protein, 9 aa, Homo sapiens
  light chain complementarity determining region 3 for antibody 57971
QQFNNYPLT

SEQ ID NO: 115942 - protein, 15 aa, Homo sapiens
  heavy chain complementarity determining region 3 for antibody 57971
AKALYSGSYYTFFDY

SEQ ID NO: 115943 - protein, 9 aa, Homo sapiens
  light chain complementarity determining region 3 for antibody 57972
QQFNNYAYT

SEQ ID NO: 115944 - protein, 14 aa, Homo sapiens
  heavy chain complementarity determining region 3 for antibody 57972
ARRFRISVSAPFDY

SEQ ID NO: 115945 - protein, 8 aa, Homo sapiens
  light chain complementarity determining region 3 for antibody 57973
QQFNDYYT

SEQ ID NO: 115946 - protein, 10 aa, Homo sapiens
  heavy chain complementarity determining region 3 for antibody 57973
ARIDSGRFDY

SEQ ID NO: 115947 - protein, 9 aa, Homo sapiens
  light chain complementarity determining region 3 for antibody 57974
QQDYNLPYT

SEQ ID NO: 115948 - protein, 19 aa, Homo sapiens
  heavy chain complementarity determining region 3 for antibody 57974
TRERNPTTGYYNYFYGMDV

SEQ ID NO: 115949 - protein, 9 aa, Homo sapiens
  light chain complementarity determining region 3 for antibody 57975
QQDYNLPLT

SEQ ID NO: 115950 - protein, 15 aa, Homo sapiens
  heavy chain complementarity determining region 3 for antibody 57975
ARDHPTVTTIGGFDY

SEQ ID NO: 115951 - protein, 9 aa, Homo sapiens
  light chain complementarity determining region 3 for antibody 57976
QQCYSTPRT

SEQ ID NO: 115952 - protein, 20 aa, Homo sapiens
  heavy chain complementarity determining region 3 for antibody 57976
ARDAGVWFVDPYYYYNGMAV

SEQ ID NO: 115953 - protein, 9 aa, Homo sapiens
  light chain complementarity determining region 3 for antibody 57977
QQCYSTPRT

SEQ ID NO: 115954 - protein, 19 aa, Homo sapiens
  heavy chain complementarity determining region 3 for antibody 57977
ARDAGVWFVDPYYYNGMDV

SEQ ID NO: 115955 - protein, 9 aa, Homo sapiens
  light chain complementarity determining region 3 for antibody 57978
QKYNSATWT

SEQ ID NO: 115956 - protein, 15 aa, Homo sapiens
  heavy chain complementarity determining region 3 for antibody 57978
AKAGDYYGSGSPFDY

SEQ ID NO: 115957 - protein, 9 aa, Homo sapiens
  light chain complementarity determining region 3 for antibody 57979
QKYNSAPWT

SEQ ID NO: 115958 - protein, 15 aa, Homo sapiens
  heavy chain complementarity determining region 3 for antibody 57979
AKSGDYYGSGSPFDY

SEQ ID NO: 115959 - protein, 9 aa, Homo sapiens
  light chain complementarity determining region 3 for antibody 57980
QKYNSAPWT

SEQ ID NO: 115960 - protein, 15 aa, Homo sapiens
  heavy chain complementarity determining region 3 for antibody 57980
AKAGDYYGSGSPFVY

SEQ ID NO: 115961 - protein, 9 aa, Homo sapiens
  light chain complementarity determining region 3 for antibody 57981
QKYNSAPWT

SEQ ID NO: 115962 - protein, 15 aa, Homo sapiens
  heavy chain complementarity determining region 3 for antibody 57981
AKAGDYYGSGSPFDF

SEQ ID NO: 115963 - protein, 9 aa, Homo sapiens
  light chain complementarity determining region 3 for antibody 57982
QKYNSAPWT

SEQ ID NO: 115964 - protein, 15 aa, Homo sapiens
  heavy chain complementarity determining region 3 for antibody 57982
AKAGDYYGSGSLFDY

SEQ ID NO: 115965 - protein, 9 aa, Homo sapiens
  light chain complementarity determining region 3 for antibody 57983
QKYNSAPWT

SEQ ID NO: 115966 - protein, 15 aa, Homo sapiens
  heavy chain complementarity determining region 3 for antibody 57983
AKAGDYYGSGNPFDY

SEQ ID NO: 115967 - protein, 9 aa, Homo sapiens
  light chain complementarity determining region 3 for antibody 57984
QKYNSAPWT

SEQ ID NO: 115968 - protein, 15 aa, Homo sapiens
  heavy chain complementarity determining region 3 for antibody 57984
AKAGDYYGSDSPFDY

SEQ ID NO: 115969 - protein, 9 aa, Homo sapiens
  light chain complementarity determining region 3 for antibody 57985
QKYNSAPWT

SEQ ID NO: 115970 - protein, 15 aa, Homo sapiens
  heavy chain complementarity determining region 3 for antibody 57985
AKAGDYYGSASPSDY

SEQ ID NO: 115971 - protein, 9 aa, Homo sapiens
  light chain complementarity determining region 3 for antibody 57986
QKYNSAPWT

SEQ ID NO: 115972 - protein, 15 aa, Homo sapiens
  heavy chain complementarity determining region 3 for antibody 57986
AKAGDYDGAGSPFDY

SEQ ID NO: 115973 - protein, 9 aa, Homo sapiens
  light chain complementarity determining region 3 for antibody 57987
QKYNSAPWT

SEQ ID NO: 115974 - protein, 15 aa, Homo sapiens
  heavy chain complementarity determining region 3 for antibody 57987
AKAGDCYGSGGPFDY

SEQ ID NO: 115975 - protein, 9 aa, Homo sapiens
  light chain complementarity determining region 3 for antibody 57988
QKYNSAPWT

SEQ ID NO: 115976 - protein, 15 aa, Homo sapiens
  heavy chain complementarity determining region 3 for antibody 57988
AEAGDYYGSWSPFDY

SEQ ID NO: 115977 - protein, 9 aa, Homo sapiens
  light chain complementarity determining region 3 for antibody 57989
QKYNSAPWT

SEQ ID NO: 115978 - protein, 15 aa, Homo sapiens
  heavy chain complementarity determining region 3 for antibody 57989
AEAGDCYGSGSPFDY

SEQ ID NO: 115979 - protein, 9 aa, Homo sapiens
  light chain complementarity determining region 3 for antibody 57990
QKYNSAPCT

SEQ ID NO: 115980 - protein, 15 aa, Homo sapiens
  heavy chain complementarity determining region 3 for antibody 57990
AKAGDYYGSGSPFDY

SEQ ID NO: 115981 - protein, 9 aa, Homo sapiens
  light chain complementarity determining region 3 for antibody 57991
MQALQTIFT

SEQ ID NO: 115982 - protein, 20 aa, Homo sapiens
  heavy chain complementarity determining region 3 for antibody 57991
AKDSATYYDILTGYYYGMDV

SEQ ID NO: 115983 - protein, 9 aa, Homo sapiens
  light chain complementarity determining region 3 for antibody 57992
LQNYNYPYT

SEQ ID NO: 115984 - protein, 13 aa, Homo sapiens
  heavy chain complementarity determining region 3 for antibody 57992
ARDLAGAGYPFDF

SEQ ID NO: 115985 - protein, 9 aa, Homo sapiens
  light chain complementarity determining region 3 for antibody 57993
LQHNSYPYT

SEQ ID NO: 115986 - protein, 14 aa, Homo sapiens
  heavy chain complementarity determining region 3 for antibody 57993
ARGLRYVDWLSQDY

SEQ ID NO: 115987 - protein, 9 aa, Homo sapiens
  light chain complementarity determining region 3 for antibody 57994
LQHNSYPYT

SEQ ID NO: 115988 - protein, 14 aa, Homo sapiens
  heavy chain complementarity determining region 3 for antibody 57994
ARGLRYSDWLSQDY

SEQ ID NO: 115989 - protein, 9 aa, Homo sapiens
  light chain complementarity determining region 3 for antibody 57995
LQHNSYPYT

SEQ ID NO: 115990 - protein, 13 aa, Homo sapiens
  heavy chain complementarity determining region 3 for antibody 57995
ARGGYYGSGSLDY

SEQ ID NO: 115991 - protein, 9 aa, Homo sapiens
  light chain complementarity determining region 3 for antibody 57996
LQHNSYPYT

SEQ ID NO: 115992 - protein, 9 aa, Homo sapiens
  heavy chain complementarity determining region 3 for antibody 57996
AREVGASAY

SEQ ID NO: 115993 - protein, 9 aa, Homo sapiens
  light chain complementarity determining region 3 for antibody 57997
LQHNSYPYT

SEQ ID NO: 115994 - protein, 11 aa, Homo sapiens
  heavy chain complementarity determining region 3 for antibody 57997
ARAIVGATFDY

SEQ ID NO: 115995 - protein, 9 aa, Homo sapiens
  light chain complementarity determining region 3 for antibody 57998
LQHNSYPYT

SEQ ID NO: 115996 - protein, 12 aa, Homo sapiens
  heavy chain complementarity determining region 3 for antibody 57998
AKGRSYYYGMDV

SEQ ID NO: 115997 - protein, 9 aa, Homo sapiens
  light chain complementarity determining region 3 for antibody 57999
LQHNSYPYT

SEQ ID NO: 115998 - protein, 12 aa, Homo sapiens
  heavy chain complementarity determining region 3 for antibody 57999
AKDRSYCYGMDV

SEQ ID NO: 115999 - protein, 9 aa, Homo sapiens
  light chain complementarity determining region 3 for antibody 58000
LQHNSYPYT

SEQ ID NO: 116000 - protein, 16 aa, Homo sapiens
  heavy chain complementarity determining region 3 for antibody 58000
AKDGSGSYYLTEDFQH

SEQ ID NO: 116001 - protein, 9 aa, Homo sapiens
  light chain complementarity determining region 3 for antibody 58001
LQHNSYPWT

SEQ ID NO: 116002 - protein, 23 aa, Homo sapiens
  heavy chain complementarity determining region 3 for antibody 58001
ATGDDYVWGSYRYTNSYYYGMDV

SEQ ID NO: 116003 - protein, 9 aa, Homo sapiens
  light chain complementarity determining region 3 for antibody 58002
LQHNSYPWT

SEQ ID NO: 116004 - protein, 20 aa, Homo sapiens
  heavy chain complementarity determining region 3 for antibody 58002
ATDTMVRGGIIEDYYYGMDV

SEQ ID NO: 116005 - protein, 9 aa, Homo sapiens
  light chain complementarity determining region 3 for antibody 58003
LQHNSYPWT

SEQ ID NO: 116006 - protein, 20 aa, Homo sapiens
  heavy chain complementarity determining region 3 for antibody 58003
ATDAMVRGVIIEDYYYGMDV

SEQ ID NO: 116007 - protein, 9 aa, Homo sapiens
  light chain complementarity determining region 3 for antibody 58004
LQHNSYPWT

SEQ ID NO: 116008 - protein, 16 aa, Homo sapiens
  heavy chain complementarity determining region 3 for antibody 58004
ASLYYYGSGGMEAFDI

SEQ ID NO: 116009 - protein, 9 aa, Homo sapiens
  light chain complementarity determining region 3 for antibody 58005
LQHNSYPWT

SEQ ID NO: 116010 - protein, 22 aa, Homo sapiens
  heavy chain complementarity determining region 3 for antibody 58005
ARDVPLYYDILTGYPYYHGMDV

SEQ ID NO: 116011 - protein, 9 aa, Homo sapiens
  light chain complementarity determining region 3 for antibody 58006
LQHNSYPRT

SEQ ID NO: 116012 - protein, 9 aa, Homo sapiens
  heavy chain complementarity determining region 3 for antibody 58006
AVWFGELDY

SEQ ID NO: 116013 - protein, 9 aa, Homo sapiens
  light chain complementarity determining region 3 for antibody 58007
LQHNSYPRT

SEQ ID NO: 116014 - protein, 13 aa, Homo sapiens
  heavy chain complementarity determining region 3 for antibody 58007
AREYCSSSSCYDH

SEQ ID NO: 116015 - protein, 9 aa, Homo sapiens
  light chain complementarity determining region 3 for antibody 58008
LQHNSYPIT

SEQ ID NO: 116016 - protein, 21 aa, Homo sapiens
  heavy chain complementarity determining region 3 for antibody 58008
ARPDYYGSGPTPYYYYYGMDV

SEQ ID NO: 116017 - protein, 9 aa, Homo sapiens
  light chain complementarity determining region 3 for antibody 58009
LQHNSYPFT

SEQ ID NO: 116018 - protein, 10 aa, Homo sapiens
  heavy chain complementarity determining region 3 for antibody 58009
ASDSSGCLDY

SEQ ID NO: 116019 - protein, 9 aa, Homo sapiens
  light chain complementarity determining region 3 for antibody 58010
LQHNSYPFT

SEQ ID NO: 116020 - protein, 10 aa, Homo sapiens
  heavy chain complementarity determining region 3 for antibody 58010
ARESSGWLDY

SEQ ID NO: 116021 - protein, 9 aa, Homo sapiens
  light chain complementarity determining region 3 for antibody 58011
LQHNSYPFT

SEQ ID NO: 116022 - protein, 10 aa, Homo sapiens
  heavy chain complementarity determining region 3 for antibody 58011
ARDSTGCLDY

SEQ ID NO: 116023 - protein, 9 aa, Homo sapiens
  light chain complementarity determining region 3 for antibody 58012
LQHNSYPFT

SEQ ID NO: 116024 - protein, 10 aa, Homo sapiens
  heavy chain complementarity determining region 3 for antibody 58012
ARDSSGWFDY

SEQ ID NO: 116025 - protein, 9 aa, Homo sapiens
  light chain complementarity determining region 3 for antibody 58013
LQHNSYPFT

SEQ ID NO: 116026 - protein, 10 aa, Homo sapiens
  heavy chain complementarity determining region 3 for antibody 58013
AIDSSGWLDY

SEQ ID NO: 116027 - protein, 9 aa, Homo sapiens
  light chain complementarity determining region 3 for antibody 58014
LQHDNFPYT

SEQ ID NO: 116028 - protein, 13 aa, Homo sapiens
  heavy chain complementarity determining region 3 for antibody 58014
ARDQDYGSGSTDY

SEQ ID NO: 116029 - protein, 9 aa, Homo sapiens
  light chain complementarity determining region 3 for antibody 58015
LQDYTYPYT

SEQ ID NO: 116030 - protein, 16 aa, Homo sapiens
  heavy chain complementarity determining region 3 for antibody 58015
VRGYYGSGTSSRWFDH

SEQ ID NO: 116031 - protein, 9 aa, Homo sapiens
  light chain complementarity determining region 3 for antibody 58016
LQDYNYPYT

SEQ ID NO: 116032 - protein, 16 aa, Homo sapiens
  heavy chain complementarity determining region 3 for antibody 58016
ARGYFGSGSSSRWFAP

SEQ ID NO: 116033 - protein, 9 aa, Homo sapiens
  light chain complementarity determining region 3 for antibody 58017
LQDYNYPYT

SEQ ID NO: 116034 - protein, 18 aa, Homo sapiens
  heavy chain complementarity determining region 3 for antibody 58017
ARGAWYYYGSASYYTFDY

SEQ ID NO: 116035 - protein, 9 aa, Homo sapiens
  light chain complementarity determining region 3 for antibody 58018
LQDYNYPYT

SEQ ID NO: 116036 - protein, 18 aa, Homo sapiens
  heavy chain complementarity determining region 3 for antibody 58018
ARERGLLWFGELGSGMDV

SEQ ID NO: 116037 - protein, 9 aa, Homo sapiens
  light chain complementarity determining region 3 for antibody 58019
LQDYNYPYT

SEQ ID NO: 116038 - protein, 15 aa, Homo sapiens
  heavy chain complementarity determining region 3 for antibody 58019
AEEGKLRYFDWLGDY

SEQ ID NO: 116039 - protein, 9 aa, Homo sapiens
  light chain complementarity determining region 3 for antibody 58020
LQDYNYPWT

SEQ ID NO: 116040 - protein, 11 aa, Homo sapiens
  heavy chain complementarity determining region 3 for antibody 58020
ATGSPLLWLGD

SEQ ID NO: 116041 - protein, 9 aa, Homo sapiens
  light chain complementarity determining region 3 for antibody 58021
LQDYNYPWT

SEQ ID NO: 116042 - protein, 11 aa, Homo sapiens
  heavy chain complementarity determining region 3 for antibody 58021
ATGSPLLCFAD

SEQ ID NO: 116043 - protein, 9 aa, Homo sapiens
  light chain complementarity determining region 3 for antibody 58022
LQDYNYPWT

SEQ ID NO: 116044 - protein, 11 aa, Homo sapiens
  heavy chain complementarity determining region 3 for antibody 58022
ATGAPLLWFGD

SEQ ID NO: 116045 - protein, 9 aa, Homo sapiens
  light chain complementarity determining region 3 for antibody 58023
LQDYNYPWT

SEQ ID NO: 116046 - protein, 14 aa, Homo sapiens
  heavy chain complementarity determining region 3 for antibody 58023
ARGLLWSGGYGMDV

SEQ ID NO: 116047 - protein, 9 aa, Homo sapiens
  light chain complementarity determining region 3 for antibody 58024
LQDYNYPWT

SEQ ID NO: 116048 - protein, 14 aa, Homo sapiens
  heavy chain complementarity determining region 3 for antibody 58024
ARGLLWSGGYGLDV

SEQ ID NO: 116049 - protein, 9 aa, Homo sapiens
  light chain complementarity determining region 3 for antibody 58025
LQDYNYPWT

SEQ ID NO: 116050 - protein, 13 aa, Homo sapiens
  heavy chain complementarity determining region 3 for antibody 58025
ARGEVNWGAFFDY

SEQ ID NO: 116051 - protein, 9 aa, Homo sapiens
  light chain complementarity determining region 3 for antibody 58026
LQDYNYPWT

SEQ ID NO: 116052 - protein, 13 aa, Homo sapiens
  heavy chain complementarity determining region 3 for antibody 58026
AREYSGYDAHIDY

SEQ ID NO: 116053 - protein, 9 aa, Homo sapiens
  light chain complementarity determining region 3 for antibody 58027
LQDYNYPWT

SEQ ID NO: 116054 - protein, 13 aa, Homo sapiens
  heavy chain complementarity determining region 3 for antibody 58027
AREEVNWGAVFDY

SEQ ID NO: 116055 - protein, 9 aa, Homo sapiens
  light chain complementarity determining region 3 for antibody 58028
LQDYNYPWT

SEQ ID NO: 116056 - protein, 10 aa, Homo sapiens
  heavy chain complementarity determining region 3 for antibody 58028
ARDRVGATPY

SEQ ID NO: 116057 - protein, 9 aa, Homo sapiens
  light chain complementarity determining region 3 for antibody 58029
LQDYNYPWT

SEQ ID NO: 116058 - protein, 13 aa, Homo sapiens
  heavy chain complementarity determining region 3 for antibody 58029
ARAPSPRYYGMDV

SEQ ID NO: 116059 - protein, 9 aa, Homo sapiens
  light chain complementarity determining region 3 for antibody 58030
LQDYNYPWT

SEQ ID NO: 116060 - protein, 11 aa, Homo sapiens
  heavy chain complementarity determining region 3 for antibody 58030
APGSPLLWFGD

SEQ ID NO: 116061 - protein, 9 aa, Homo sapiens
  light chain complementarity determining region 3 for antibody 58031
LQDYNYPWT

SEQ ID NO: 116062 - protein, 14 aa, Homo sapiens
  heavy chain complementarity determining region 3 for antibody 58031
AKGRGFDWYIDWSY

SEQ ID NO: 116063 - protein, 9 aa, Homo sapiens
  light chain complementarity determining region 3 for antibody 58032
LQDYNYPWT

SEQ ID NO: 116064 - protein, 14 aa, Homo sapiens
  heavy chain complementarity determining region 3 for antibody 58032
AKGRGFDWYIDWGY

SEQ ID NO: 116065 - protein, 9 aa, Homo sapiens
  light chain complementarity determining region 3 for antibody 58033
LQDYNYPWT

SEQ ID NO: 116066 - protein, 15 aa, Homo sapiens
  heavy chain complementarity determining region 3 for antibody 58033
AKAGDYYGSGSPFDY

SEQ ID NO: 116067 - protein, 9 aa, Homo sapiens
  light chain complementarity determining region 3 for antibody 58034
LQDYNYPWT

SEQ ID NO: 116068 - protein, 14 aa, Homo sapiens
  heavy chain complementarity determining region 3 for antibody 58034
AGRHYDILSGFSDY

SEQ ID NO: 116069 - protein, 9 aa, Homo sapiens
  light chain complementarity determining region 3 for antibody 58035
LQDYNYPWT

SEQ ID NO: 116070 - protein, 14 aa, Homo sapiens
  heavy chain complementarity determining region 3 for antibody 58035
AGGLLWFGGYGMDV

SEQ ID NO: 116071 - protein, 9 aa, Homo sapiens
  light chain complementarity determining region 3 for antibody 58036
LQDYNYPWT

SEQ ID NO: 116072 - protein, 11 aa, Homo sapiens
  heavy chain complementarity determining region 3 for antibody 58036
AAGSPLLWFGD

SEQ ID NO: 116073 - protein, 9 aa, Homo sapiens
  light chain complementarity determining region 3 for antibody 58037
LQDYNYPRT

SEQ ID NO: 116074 - protein, 15 aa, Homo sapiens
  heavy chain complementarity determining region 3 for antibody 58037
ATLPYYDSLTGYSDY

SEQ ID NO: 116075 - protein, 9 aa, Homo sapiens
  light chain complementarity determining region 3 for antibody 58038
LQDYNYPLT

SEQ ID NO: 116076 - protein, 15 aa, Homo sapiens
  heavy chain complementarity determining region 3 for antibody 58038
AKGTAPTYFYNGLDV

SEQ ID NO: 116077 - protein, 9 aa, Homo sapiens
  light chain complementarity determining region 3 for antibody 58039
LQDYDYPWT

SEQ ID NO: 116078 - protein, 13 aa, Homo sapiens
  heavy chain complementarity determining region 3 for antibody 58039
AREYSGYDAHFDY

SEQ ID NO: 116079 - protein, 9 aa, Homo sapiens
  light chain complementarity determining region 3 for antibody 58040
HQYNSYPFT

SEQ ID NO: 116080 - protein, 13 aa, Homo sapiens
  heavy chain complementarity determining region 3 for antibody 58040
ARERWAANACFDY

SEQ ID NO: 116081 - protein, 9 aa, Homo sapiens
  light chain complementarity determining region 3 for antibody 58041
HQTSTLPHA

SEQ ID NO: 116082 - protein, 14 aa, Homo sapiens
  heavy chain complementarity determining region 3 for antibody 58041
ARRGRVGGTSHFDY

SEQ ID NO: 116083 - protein, 9 aa, Homo sapiens
  light chain complementarity determining region 3 for antibody 58042
HQSSSLPYT

SEQ ID NO: 116084 - protein, 13 aa, Homo sapiens
  heavy chain complementarity determining region 3 for antibody 58042
ARGGYYGSGSLDY

SEQ ID NO: 116085 - protein, 9 aa, Homo sapiens
  light chain complementarity determining region 3 for antibody 58043
HQSSSLPYT

SEQ ID NO: 116086 - protein, 11 aa, Homo sapiens
  heavy chain complementarity determining region 3 for antibody 58043
ARDPHFFGSES

SEQ ID NO: 116087 - protein, 9 aa, Homo sapiens
  light chain complementarity determining region 3 for antibody 58044
HQSSSLPYT

SEQ ID NO: 116088 - protein, 11 aa, Homo sapiens
  heavy chain complementarity determining region 3 for antibody 58044
ARALVFDAFDI

SEQ ID NO: 116089 - protein, 9 aa, Homo sapiens
  light chain complementarity determining region 3 for antibody 58045
HQSSSLPWT

SEQ ID NO: 116090 - protein, 11 aa, Homo sapiens
  heavy chain complementarity determining region 3 for antibody 58045
ARYYWNDYFDF

SEQ ID NO: 116091 - protein, 9 aa, Homo sapiens
  light chain complementarity determining region 3 for antibody 58046
HQSSSLPLT

SEQ ID NO: 116092 - protein, 13 aa, Homo sapiens
  heavy chain complementarity determining region 3 for antibody 58046
ARGGYSGSGSLDY

SEQ ID NO: 116093 - protein, 9 aa, Homo sapiens
  light chain complementarity determining region 3 for antibody 58047
HQSSSLPIT

SEQ ID NO: 116094 - protein, 9 aa, Homo sapiens
  heavy chain complementarity determining region 3 for antibody 58047
AKEIWFFDL

SEQ ID NO: 116095 - protein, 9 aa, Homo sapiens
  light chain complementarity determining region 3 for antibody 58048
HQSSSLPHT

SEQ ID NO: 116096 - protein, 13 aa, Homo sapiens
  heavy chain complementarity determining region 3 for antibody 58048
ARGGYYGSGSLDS

SEQ ID NO: 116097 - protein, 9 aa, Homo sapiens
  light chain complementarity determining region 3 for antibody 58049
HQSSSLPHT

SEQ ID NO: 116098 - protein, 13 aa, Homo sapiens
  heavy chain complementarity determining region 3 for antibody 58049
ARGGYYGSGILDY

SEQ ID NO: 116099 - protein, 9 aa, Homo sapiens
  light chain complementarity determining region 3 for antibody 58050
HQSSSLPHT

SEQ ID NO: 116100 - protein, 13 aa, Homo sapiens
  heavy chain complementarity determining region 3 for antibody 58050
ARGGYYGAGGLDY

SEQ ID NO: 116101 - protein, 9 aa, Homo sapiens
  light chain complementarity determining region 3 for antibody 58051
RQFYNYPHT

SEQ ID NO: 116102 - protein, 13 aa, Homo sapiens
  heavy chain complementarity determining region 3 for antibody 58051
GRFLEGIGGAFDI

SEQ ID NO: 116103 - protein, 9 aa, Homo sapiens
  light chain complementarity determining region 3 for antibody 58052
QRTYNAPYT

SEQ ID NO: 116104 - protein, 18 aa, Homo sapiens
  heavy chain complementarity determining region 3 for antibody 58052
ARDRIAAAGTDYYYGMDV

SEQ ID NO: 116105 - protein, 9 aa, Homo sapiens
  light chain complementarity determining region 3 for antibody 58053
QRTYNAPYT

SEQ ID NO: 116106 - protein, 18 aa, Homo sapiens
  heavy chain complementarity determining region 3 for antibody 58053
ARDMRAAAGTDYYYGMDV

SEQ ID NO: 116107 - protein, 9 aa, Homo sapiens
  light chain complementarity determining region 3 for antibody 58054
QRTYNAPYT

SEQ ID NO: 116108 - protein, 18 aa, Homo sapiens
  heavy chain complementarity determining region 3 for antibody 58054
ARDMIAAAGADYYYGMDV

SEQ ID NO: 116109 - protein, 9 aa, Homo sapiens
  light chain complementarity determining region 3 for antibody 58055
QQYYNTPRT

SEQ ID NO: 116110 - protein, 18 aa, Homo sapiens
  heavy chain complementarity determining region 3 for antibody 58055
AREGDSSGPFSYYYGMDV

SEQ ID NO: 116111 - protein, 9 aa, Homo sapiens
  light chain complementarity determining region 3 for antibody 58056
QQYNSYPYT

SEQ ID NO: 116112 - protein, 9 aa, Homo sapiens
  heavy chain complementarity determining region 3 for antibody 58056
VRYSYGMDV

SEQ ID NO: 116113 - protein, 9 aa, Homo sapiens
  light chain complementarity determining region 3 for antibody 58057
QQYNSYPYT

SEQ ID NO: 116114 - protein, 10 aa, Homo sapiens
  heavy chain complementarity determining region 3 for antibody 58057
ARSTWGDFDY

SEQ ID NO: 116115 - protein, 9 aa, Homo sapiens
  light chain complementarity determining region 3 for antibody 58058
QQYNSYPYT

SEQ ID NO: 116116 - protein, 10 aa, Homo sapiens
  heavy chain complementarity determining region 3 for antibody 58058
ARSNWGAFDY

SEQ ID NO: 116117 - protein, 9 aa, Homo sapiens
  light chain complementarity determining region 3 for antibody 58059
QQYNSYPYT

SEQ ID NO: 116118 - protein, 11 aa, Homo sapiens
  heavy chain complementarity determining region 3 for antibody 58059
ARGDSSGGFDY

SEQ ID NO: 116119 - protein, 9 aa, Homo sapiens
  light chain complementarity determining region 3 for antibody 58060
QQYNSYPYT

SEQ ID NO: 116120 - protein, 15 aa, Homo sapiens
  heavy chain complementarity determining region 3 for antibody 58060
AREGATRTYYYGMDV

SEQ ID NO: 116121 - protein, 9 aa, Homo sapiens
  light chain complementarity determining region 3 for antibody 58061
QQYNSYPYT

SEQ ID NO: 116122 - protein, 18 aa, Homo sapiens
  heavy chain complementarity determining region 3 for antibody 58061
ARDGHYDGSGSYEDWFDP

SEQ ID NO: 116123 - protein, 9 aa, Homo sapiens
  light chain complementarity determining region 3 for antibody 58062
QQYNSYPRT

SEQ ID NO: 116124 - protein, 21 aa, Homo sapiens
  heavy chain complementarity determining region 3 for antibody 58062
ASETDYDILTGPYYNYYTMDV

SEQ ID NO: 116125 - protein, 9 aa, Homo sapiens
  light chain complementarity determining region 3 for antibody 58063
QQYNSYPRT

SEQ ID NO: 116126 - protein, 21 aa, Homo sapiens
  heavy chain complementarity determining region 3 for antibody 58063
ARETDYEILTGPYYNYYTMDV

SEQ ID NO: 116127 - protein, 9 aa, Homo sapiens
  light chain complementarity determining region 3 for antibody 58064
QQYNSYPRT

SEQ ID NO: 116128 - protein, 21 aa, Homo sapiens
  heavy chain complementarity determining region 3 for antibody 58064
ARETDYDILTGPYYNYSTMDV

SEQ ID NO: 116129 - protein, 9 aa, Homo sapiens
  light chain complementarity determining region 3 for antibody 58065
QQYNSYPRT

SEQ ID NO: 116130 - protein, 21 aa, Homo sapiens
  heavy chain complementarity determining region 3 for antibody 58065
ARETDYDILSGPYYNYYTMDV

SEQ ID NO: 116131 - protein, 9 aa, Homo sapiens
  light chain complementarity determining region 3 for antibody 58066
QQYNSYPRT

SEQ ID NO: 116132 - protein, 21 aa, Homo sapiens
  heavy chain complementarity determining region 3 for antibody 58066
ARETDSDILTGPYYNYYTMDV

SEQ ID NO: 116133 - protein, 9 aa, Homo sapiens
  light chain complementarity determining region 3 for antibody 58067
QQYNSYPRT

SEQ ID NO: 116134 - protein, 9 aa, Homo sapiens
  heavy chain complementarity determining region 3 for antibody 58067
ARDWEAFDI

SEQ ID NO: 116135 - protein, 9 aa, Homo sapiens
  light chain complementarity determining region 3 for antibody 58068
QQYNSYPPT

SEQ ID NO: 116136 - protein, 14 aa, Homo sapiens
  heavy chain complementarity determining region 3 for antibody 58068
AGDHSGSYFNWFDP

SEQ ID NO: 116137 - protein, 9 aa, Homo sapiens
  light chain complementarity determining region 3 for antibody 58069
QQYNSYPLT

SEQ ID NO: 116138 - protein, 16 aa, Homo sapiens
  heavy chain complementarity determining region 3 for antibody 58069
ARRGAGSYSHGYGMDV

SEQ ID NO: 116139 - protein, 9 aa, Homo sapiens
  light chain complementarity determining region 3 for antibody 58070
QQYNSYPLT

SEQ ID NO: 116140 - protein, 9 aa, Homo sapiens
  heavy chain complementarity determining region 3 for antibody 58070
ARGKAAAAP

SEQ ID NO: 116141 - protein, 9 aa, Homo sapiens
  light chain complementarity determining region 3 for antibody 58071
QQYNSYPLT

SEQ ID NO: 116142 - protein, 16 aa, Homo sapiens
  heavy chain complementarity determining region 3 for antibody 58071
AGRGSGSYSHGYGMDV

SEQ ID NO: 116143 - protein, 9 aa, Homo sapiens
  light chain complementarity determining region 3 for antibody 58072
QQYNSYPIT

SEQ ID NO: 116144 - protein, 12 aa, Homo sapiens
  heavy chain complementarity determining region 3 for antibody 58072
ARVVRGARGFDY

SEQ ID NO: 116145 - protein, 9 aa, Homo sapiens
  light chain complementarity determining region 3 for antibody 58073
QQYNSYPIT

SEQ ID NO: 116146 - protein, 10 aa, Homo sapiens
  heavy chain complementarity determining region 3 for antibody 58073
ARVVRGAFDY

SEQ ID NO: 116147 - protein, 9 aa, Homo sapiens
  light chain complementarity determining region 3 for antibody 58074
QQYNSYPIT

SEQ ID NO: 116148 - protein, 12 aa, Homo sapiens
  heavy chain complementarity determining region 3 for antibody 58074
AREVRGVRGFDY

SEQ ID NO: 116149 - protein, 9 aa, Homo sapiens
  light chain complementarity determining region 3 for antibody 58075
QQYNSYPFT

SEQ ID NO: 116150 - protein, 14 aa, Homo sapiens
  heavy chain complementarity determining region 3 for antibody 58075
AREGNYSYYYGMDV

SEQ ID NO: 116151 - protein, 9 aa, Homo sapiens
  light chain complementarity determining region 3 for antibody 58076
QQYNSAPWT

SEQ ID NO: 116152 - protein, 15 aa, Homo sapiens
  heavy chain complementarity determining region 3 for antibody 58076
AKAGDYYGSGSAFDY

SEQ ID NO: 116153 - protein, 9 aa, Homo sapiens
  light chain complementarity determining region 3 for antibody 58077
QQYNNWPYT

SEQ ID NO: 116154 - protein, 18 aa, Homo sapiens
  heavy chain complementarity determining region 3 for antibody 58077
AKDRLAYCGGDCYSNIDY

SEQ ID NO: 116155 - protein, 10 aa, Homo sapiens
  light chain complementarity determining region 3 for antibody 58078
QQYNNWPPLT

SEQ ID NO: 116156 - protein, 16 aa, Homo sapiens
  heavy chain complementarity determining region 3 for antibody 58078
ARDRNWGPPLYWYFDL

SEQ ID NO: 116157 - protein, 9 aa, Homo sapiens
  light chain complementarity determining region 3 for antibody 58079
QQYNNWPLT

SEQ ID NO: 116158 - protein, 18 aa, Homo sapiens
  heavy chain complementarity determining region 3 for antibody 58079
TRDLRPPGIAGAEGAFDI

SEQ ID NO: 116159 - protein, 9 aa, Homo sapiens
  light chain complementarity determining region 3 for antibody 58080
QQYNNWPLT

SEQ ID NO: 116160 - protein, 16 aa, Homo sapiens
  heavy chain complementarity determining region 3 for antibody 58080
ANEGYYGSGSYGWFDP

SEQ ID NO: 116161 - protein, 9 aa, Homo sapiens
  light chain complementarity determining region 3 for antibody 58081
QQYNGYPPT

SEQ ID NO: 116162 - protein, 14 aa, Homo sapiens
  heavy chain complementarity determining region 3 for antibody 58081
ARDHSGSYFNWFDP

SEQ ID NO: 116163 - protein, 9 aa, Homo sapiens
  light chain complementarity determining region 3 for antibody 58082
QQYGSSPYT

SEQ ID NO: 116164 - protein, 16 aa, Homo sapiens
  heavy chain complementarity determining region 3 for antibody 58082
ARSLLRYFDFSNYFDY

SEQ ID NO: 116165 - protein, 9 aa, Homo sapiens
  light chain complementarity determining region 3 for antibody 58083
QQYGSSPYT

SEQ ID NO: 116166 - protein, 16 aa, Homo sapiens
  heavy chain complementarity determining region 3 for antibody 58083
ARSLLRYFDFRNSFDY

SEQ ID NO: 116167 - protein, 9 aa, Homo sapiens
  light chain complementarity determining region 3 for antibody 58084
QQYGSSPYT

SEQ ID NO: 116168 - protein, 16 aa, Homo sapiens
  heavy chain complementarity determining region 3 for antibody 58084
ARESPYYDSLTGFFDY

SEQ ID NO: 116169 - protein, 9 aa, Homo sapiens
  light chain complementarity determining region 3 for antibody 58085
QQYGSSPYT

SEQ ID NO: 116170 - protein, 16 aa, Homo sapiens
  heavy chain complementarity determining region 3 for antibody 58085
AGESPYYDILTGFFDY

SEQ ID NO: 116171 - protein, 9 aa, Homo sapiens
  light chain complementarity determining region 3 for antibody 58086
QQYGSSPYT

SEQ ID NO: 116172 - protein, 16 aa, Homo sapiens
  heavy chain complementarity determining region 3 for antibody 58086
AEGGCSSTSCRGYFDY

SEQ ID NO: 116173 - protein, 9 aa, Homo sapiens
  light chain complementarity determining region 3 for antibody 58087
QQYGSSPWT

SEQ ID NO: 116174 - protein, 15 aa, Homo sapiens
  heavy chain complementarity determining region 3 for antibody 58087
TRDDNWDHYYYGMDV

SEQ ID NO: 116175 - protein, 9 aa, Homo sapiens
  light chain complementarity determining region 3 for antibody 58088
QQYGSSPWT

SEQ ID NO: 116176 - protein, 10 aa, Homo sapiens
  heavy chain complementarity determining region 3 for antibody 58088
ARGVRGAKDH

SEQ ID NO: 116177 - protein, 9 aa, Homo sapiens
  light chain complementarity determining region 3 for antibody 58089
QQYGSSPRT

SEQ ID NO: 116178 - protein, 14 aa, Homo sapiens
  heavy chain complementarity determining region 3 for antibody 58089
AKERLRYLDWFLDY

SEQ ID NO: 116179 - protein, 9 aa, Homo sapiens
  light chain complementarity determining region 3 for antibody 58090
QQYGSSPRT

SEQ ID NO: 116180 - protein, 14 aa, Homo sapiens
  heavy chain complementarity determining region 3 for antibody 58090
AKERLRYFDWFIDY

SEQ ID NO: 116181 - protein, 9 aa, Homo sapiens
  light chain complementarity determining region 3 for antibody 58091
QQYGSSPRT

SEQ ID NO: 116182 - protein, 14 aa, Homo sapiens
  heavy chain complementarity determining region 3 for antibody 58091
AKERLRYFDWCLDY

SEQ ID NO: 116183 - protein, 10 aa, Homo sapiens
  light chain complementarity determining region 3 for antibody 58092
QQYGSSPPYT

SEQ ID NO: 116184 - protein, 20 aa, Homo sapiens
  heavy chain complementarity determining region 3 for antibody 58092
ARETVLWFGDLPPYYYGMDV

SEQ ID NO: 116185 - protein, 10 aa, Homo sapiens
  light chain complementarity determining region 3 for antibody 58093
QQYGSSPPYT

SEQ ID NO: 116186 - protein, 12 aa, Homo sapiens
  heavy chain complementarity determining region 3 for antibody 58093
AADYYSYYGMDV

SEQ ID NO: 116187 - protein, 9 aa, Homo sapiens
  light chain complementarity determining region 3 for antibody 58094
QQYDNLPYT

SEQ ID NO: 116188 - protein, 16 aa, Homo sapiens
  heavy chain complementarity determining region 3 for antibody 58094
AGGTVDRRYSYYGMDV

SEQ ID NO: 116189 - protein, 9 aa, Homo sapiens
  light chain complementarity determining region 3 for antibody 58095
QQYDNLPYT

SEQ ID NO: 116190 - protein, 16 aa, Homo sapiens
  heavy chain complementarity determining region 3 for antibody 58095
AGGAGARRFYYYGMDV

SEQ ID NO: 116191 - protein, 9 aa, Homo sapiens
  light chain complementarity determining region 3 for antibody 58096
QQSYSTPYT

SEQ ID NO: 116192 - protein, 15 aa, Homo sapiens
  heavy chain complementarity determining region 3 for antibody 58096
ARVSWFGEWCDAFDI

SEQ ID NO: 116193 - protein, 9 aa, Homo sapiens
  light chain complementarity determining region 3 for antibody 58097
QQSFSTPFT

SEQ ID NO: 116194 - protein, 17 aa, Homo sapiens
  heavy chain complementarity determining region 3 for antibody 58097
ARAESYWDDYYYYGMDV

SEQ ID NO: 116195 - protein, 9 aa, Homo sapiens
  light chain complementarity determining region 3 for antibody 58098
QQRSNWPPT

SEQ ID NO: 116196 - protein, 13 aa, Homo sapiens
  heavy chain complementarity determining region 3 for antibody 58098
AREGGPAVAGIDY

SEQ ID NO: 116197 - protein, 9 aa, Homo sapiens
  light chain complementarity determining region 3 for antibody 58099
QQLNTYPYT

SEQ ID NO: 116198 - protein, 11 aa, Homo sapiens
  heavy chain complementarity determining region 3 for antibody 58099
ARVGGNYSFDY

SEQ ID NO: 116199 - protein, 9 aa, Homo sapiens
  light chain complementarity determining region 3 for antibody 58100
QQLNTYPYT

SEQ ID NO: 116200 - protein, 11 aa, Homo sapiens
  heavy chain complementarity determining region 3 for antibody 58100
ARIGGNYAFDY

SEQ ID NO: 116201 - protein, 9 aa, Homo sapiens
  light chain complementarity determining region 3 for antibody 58101
QQLNTYPLT

SEQ ID NO: 116202 - protein, 9 aa, Homo sapiens
  heavy chain complementarity determining region 3 for antibody 58101
ARKNGTFDY

SEQ ID NO: 116203 - protein, 9 aa, Homo sapiens
  light chain complementarity determining region 3 for antibody 58102
QQLNTYPLT

SEQ ID NO: 116204 - protein, 9 aa, Homo sapiens
  heavy chain complementarity determining region 3 for antibody 58102
ARKKGTFAY

SEQ ID NO: 116205 - protein, 9 aa, Homo sapiens
  light chain complementarity determining region 3 for antibody 58103
QQLNTYPLT

SEQ ID NO: 116206 - protein, 9 aa, Homo sapiens
  heavy chain complementarity determining region 3 for antibody 58103
ARKKGAFGY

SEQ ID NO: 116207 - protein, 9 aa, Homo sapiens
  light chain complementarity determining region 3 for antibody 58104
QQLNTYPLT

SEQ ID NO: 116208 - protein, 26 aa, Homo sapiens
  heavy chain complementarity determining region 3 for antibody 58104
ARGPTSTAYYYGSGSYYLYYYYGMDV

SEQ ID NO: 116209 - protein, 9 aa, Homo sapiens
  light chain complementarity determining region 3 for antibody 58105
QQLNSYPYT

SEQ ID NO: 116210 - protein, 17 aa, Homo sapiens
  heavy chain complementarity determining region 3 for antibody 58105
ARDPRLLWFGEFNGMDV

SEQ ID NO: 116211 - protein, 9 aa, Homo sapiens
  light chain complementarity determining region 3 for antibody 58106
QQLNSYPWT

SEQ ID NO: 116212 - protein, 17 aa, Homo sapiens
  heavy chain complementarity determining region 3 for antibody 58106
ASGYGSGSYYNYYGMDV

SEQ ID NO: 116213 - protein, 9 aa, Homo sapiens
  light chain complementarity determining region 3 for antibody 58107
QQLNSYPWT

SEQ ID NO: 116214 - protein, 13 aa, Homo sapiens
  heavy chain complementarity determining region 3 for antibody 58107
ARITMVRGVAFDY

SEQ ID NO: 116215 - protein, 9 aa, Homo sapiens
  light chain complementarity determining region 3 for antibody 58108
QQLNSYPWT

SEQ ID NO: 116216 - protein, 13 aa, Homo sapiens
  heavy chain complementarity determining region 3 for antibody 58108
ARITMVRGGSFDY

SEQ ID NO: 116217 - protein, 9 aa, Homo sapiens
  light chain complementarity determining region 3 for antibody 58109
QQLNSYPWT

SEQ ID NO: 116218 - protein, 13 aa, Homo sapiens
  heavy chain complementarity determining region 3 for antibody 58109
ARIPMVRGVSFDY

SEQ ID NO: 116219 - protein, 9 aa, Homo sapiens
  light chain complementarity determining region 3 for antibody 58110
QQLNSYPWT

SEQ ID NO: 116220 - protein, 17 aa, Homo sapiens
  heavy chain complementarity determining region 3 for antibody 58110
ARGYGSGSYYTYYGMDV

SEQ ID NO: 116221 - protein, 9 aa, Homo sapiens
  light chain complementarity determining region 3 for antibody 58111
QQLNSYPWT

SEQ ID NO: 116222 - protein, 17 aa, Homo sapiens
  heavy chain complementarity determining region 3 for antibody 58111
ARGDGSGSYYNYYGMDV

SEQ ID NO: 116223 - protein, 9 aa, Homo sapiens
  light chain complementarity determining region 3 for antibody 58112
QQLNSYPRT

SEQ ID NO: 116224 - protein, 18 aa, Homo sapiens
  heavy chain complementarity determining region 3 for antibody 58112
ARNYDIVTGYYTDDAFDI

SEQ ID NO: 116225 - protein, 9 aa, Homo sapiens
  light chain complementarity determining region 3 for antibody 58113
QQLNSYPRT

SEQ ID NO: 116226 - protein, 14 aa, Homo sapiens
  heavy chain complementarity determining region 3 for antibody 58113
ARETVAAIPEAFDI

SEQ ID NO: 116227 - protein, 9 aa, Homo sapiens
  light chain complementarity determining region 3 for antibody 58114
QQLNSYPRT

SEQ ID NO: 116228 - protein, 11 aa, Homo sapiens
  heavy chain complementarity determining region 3 for antibody 58114
AREPYSYGMDV

SEQ ID NO: 116229 - protein, 9 aa, Homo sapiens
  light chain complementarity determining region 3 for antibody 58115
QQLNSYPRT

SEQ ID NO: 116230 - protein, 12 aa, Homo sapiens
  heavy chain complementarity determining region 3 for antibody 58115
AREPYSSRGFDY

SEQ ID NO: 116231 - protein, 9 aa, Homo sapiens
  light chain complementarity determining region 3 for antibody 58116
QQLNSYPRT

SEQ ID NO: 116232 - protein, 11 aa, Homo sapiens
  heavy chain complementarity determining region 3 for antibody 58116
AREHYYYAMDV

SEQ ID NO: 116233 - protein, 9 aa, Homo sapiens
  light chain complementarity determining region 3 for antibody 58117
QQLNSYPRT

SEQ ID NO: 116234 - protein, 11 aa, Homo sapiens
  heavy chain complementarity determining region 3 for antibody 58117
AREHSYYGMDV

SEQ ID NO: 116235 - protein, 9 aa, Homo sapiens
  light chain complementarity determining region 3 for antibody 58118
QQLNSYPRT

SEQ ID NO: 116236 - protein, 11 aa, Homo sapiens
  heavy chain complementarity determining region 3 for antibody 58118
AREHFYYGMDV

SEQ ID NO: 116237 - protein, 9 aa, Homo sapiens
  light chain complementarity determining region 3 for antibody 58119
QQLNSYPRT

SEQ ID NO: 116238 - protein, 11 aa, Homo sapiens
  heavy chain complementarity determining region 3 for antibody 58119
ARDRTYYGMDV

SEQ ID NO: 116239 - protein, 9 aa, Homo sapiens
  light chain complementarity determining region 3 for antibody 58120
QQLNSYPRT

SEQ ID NO: 116240 - protein, 11 aa, Homo sapiens
  heavy chain complementarity determining region 3 for antibody 58120
ARDRRYYGVDV

SEQ ID NO: 116241 - protein, 9 aa, Homo sapiens
  light chain complementarity determining region 3 for antibody 58121
QQLNSYPRT

SEQ ID NO: 116242 - protein, 11 aa, Homo sapiens
  heavy chain complementarity determining region 3 for antibody 58121
ARDRRYYGMDD

SEQ ID NO: 116243 - protein, 9 aa, Homo sapiens
  light chain complementarity determining region 3 for antibody 58122
QQLNSYPRT

SEQ ID NO: 116244 - protein, 11 aa, Homo sapiens
  heavy chain complementarity determining region 3 for antibody 58122
ARDRGYYGMDV

SEQ ID NO: 116245 - protein, 9 aa, Homo sapiens
  light chain complementarity determining region 3 for antibody 58123
QQLNSYPRT

SEQ ID NO: 116246 - protein, 11 aa, Homo sapiens
  heavy chain complementarity determining region 3 for antibody 58123
ARDPYYYGMDV

SEQ ID NO: 116247 - protein, 9 aa, Homo sapiens
  light chain complementarity determining region 3 for antibody 58124
QQLNSYPRT

SEQ ID NO: 116248 - protein, 11 aa, Homo sapiens
  heavy chain complementarity determining region 3 for antibody 58124
ARDHYSYGMDV

SEQ ID NO: 116249 - protein, 9 aa, Homo sapiens
  light chain complementarity determining region 3 for antibody 58125
QQLNSYPRT

SEQ ID NO: 116250 - protein, 14 aa, Homo sapiens
  heavy chain complementarity determining region 3 for antibody 58125
AGETAAAIPEAFDI

SEQ ID NO: 116251 - protein, 9 aa, Homo sapiens
  light chain complementarity determining region 3 for antibody 58126
QQLNSYPPT

SEQ ID NO: 116252 - protein, 11 aa, Homo sapiens
  heavy chain complementarity determining region 3 for antibody 58126
ARAERGWYFDY

SEQ ID NO: 116253 - protein, 9 aa, Homo sapiens
  light chain complementarity determining region 3 for antibody 58127
QQLNSYPPT

SEQ ID NO: 116254 - protein, 11 aa, Homo sapiens
  heavy chain complementarity determining region 3 for antibody 58127
ARAEGGGYFDY

SEQ ID NO: 116255 - protein, 9 aa, Homo sapiens
  light chain complementarity determining region 3 for antibody 58128
QQLNSYPPT

SEQ ID NO: 116256 - protein, 13 aa, Homo sapiens
  heavy chain complementarity determining region 3 for antibody 58128
AGSFLTSYSPFDY

SEQ ID NO: 116257 - protein, 9 aa, Homo sapiens
  light chain complementarity determining region 3 for antibody 58129
QQLNSYPLT

SEQ ID NO: 116258 - protein, 12 aa, Homo sapiens
  heavy chain complementarity determining region 3 for antibody 58129
VRMVRGVIPFDY

SEQ ID NO: 116259 - protein, 9 aa, Homo sapiens
  light chain complementarity determining region 3 for antibody 58130
QQLNSYPLT

SEQ ID NO: 116260 - protein, 12 aa, Homo sapiens
  heavy chain complementarity determining region 3 for antibody 58130
ASMVRGVIPFDY

SEQ ID NO: 116261 - protein, 9 aa, Homo sapiens
  light chain complementarity determining region 3 for antibody 58131
QQLNSYPLT

SEQ ID NO: 116262 - protein, 12 aa, Homo sapiens
  heavy chain complementarity determining region 3 for antibody 58131
ARMVRGVIPFDC

SEQ ID NO: 116263 - protein, 9 aa, Homo sapiens
  light chain complementarity determining region 3 for antibody 58132
QQLNSYPLT

SEQ ID NO: 116264 - protein, 12 aa, Homo sapiens
  heavy chain complementarity determining region 3 for antibody 58132
ARIVRGVIPFDY

SEQ ID NO: 116265 - protein, 9 aa, Homo sapiens
  light chain complementarity determining region 3 for antibody 58133
QQLNSYPLT

SEQ ID NO: 116266 - protein, 15 aa, Homo sapiens
  heavy chain complementarity determining region 3 for antibody 58133
AREGGYSGYPIGMDV

SEQ ID NO: 116267 - protein, 9 aa, Homo sapiens
  light chain complementarity determining region 3 for antibody 58134
QQLNSYPLT

SEQ ID NO: 116268 - protein, 15 aa, Homo sapiens
  heavy chain complementarity determining region 3 for antibody 58134
ARDGAYSGYPIGMDV

SEQ ID NO: 116269 - protein, 9 aa, Homo sapiens
  light chain complementarity determining region 3 for antibody 58135
QQLNSYPLT

SEQ ID NO: 116270 - protein, 15 aa, Homo sapiens
  heavy chain complementarity determining region 3 for antibody 58135
AKAGDYYGSGSPFDY

SEQ ID NO: 116271 - protein, 9 aa, Homo sapiens
  light chain complementarity determining region 3 for antibody 58136
QQLNSYPLI

SEQ ID NO: 116272 - protein, 15 aa, Homo sapiens
  heavy chain complementarity determining region 3 for antibody 58136
VRGAIIDWLLYYFDY

SEQ ID NO: 116273 - protein, 9 aa, Homo sapiens
  light chain complementarity determining region 3 for antibody 58137
QQLNSYPFT

SEQ ID NO: 116274 - protein, 15 aa, Homo sapiens
  heavy chain complementarity determining region 3 for antibody 58137
ARDYYYGSGSRWFDH

SEQ ID NO: 116275 - protein, 9 aa, Homo sapiens
  light chain complementarity determining region 3 for antibody 58138
QQLNSSPYT

SEQ ID NO: 116276 - protein, 10 aa, Homo sapiens
  heavy chain complementarity determining region 3 for antibody 58138
ASGGSYYRDN

SEQ ID NO: 116277 - protein, 9 aa, Homo sapiens
  light chain complementarity determining region 3 for antibody 58139
QQLNSHPPT

SEQ ID NO: 116278 - protein, 11 aa, Homo sapiens
  heavy chain complementarity determining region 3 for antibody 58139
ARAERGGYFDY

SEQ ID NO: 116279 - protein, 9 aa, Homo sapiens
  light chain complementarity determining region 3 for antibody 58140
QQLKSYPRT

SEQ ID NO: 116280 - protein, 11 aa, Homo sapiens
  heavy chain complementarity determining region 3 for antibody 58140
ARDRRSYGMDV

SEQ ID NO: 116281 - protein, 9 aa, Homo sapiens
  light chain complementarity determining region 3 for antibody 58141
QQLHSYPFT

SEQ ID NO: 116282 - protein, 15 aa, Homo sapiens
  heavy chain complementarity determining region 3 for antibody 58141
TRDDTGYYYYYGIDV

SEQ ID NO: 116283 - protein, 9 aa, Homo sapiens
  light chain complementarity determining region 3 for antibody 58142
QQFYSYPRT

SEQ ID NO: 116284 - protein, 12 aa, Homo sapiens
  heavy chain complementarity determining region 3 for antibody 58142
ARDWGIGGGMDV

SEQ ID NO: 116285 - protein, 9 aa, Homo sapiens
  light chain complementarity determining region 3 for antibody 58143
QQFYNYPRT

SEQ ID NO: 116286 - protein, 12 aa, Homo sapiens
  heavy chain complementarity determining region 3 for antibody 58143
ARDCGIGGGMDV

SEQ ID NO: 116287 - protein, 9 aa, Homo sapiens
  light chain complementarity determining region 3 for antibody 58144
QQFYNYPHT

SEQ ID NO: 116288 - protein, 13 aa, Homo sapiens
  heavy chain complementarity determining region 3 for antibody 58144
GRFVEGIGGAFDI

SEQ ID NO: 116289 - protein, 8 aa, Homo sapiens
  light chain complementarity determining region 3 for antibody 58145
QQFNSYPT

SEQ ID NO: 116290 - protein, 13 aa, Homo sapiens
  heavy chain complementarity determining region 3 for antibody 58145
ARDVAGTTSGFDY

SEQ ID NO: 116291 - protein, 8 aa, Homo sapiens
  light chain complementarity determining region 3 for antibody 58146
QQFNSYPT

SEQ ID NO: 116292 - protein, 13 aa, Homo sapiens
  heavy chain complementarity determining region 3 for antibody 58146
AGDVTGTTSGFDY

SEQ ID NO: 116293 - protein, 9 aa, Homo sapiens
  light chain complementarity determining region 3 for antibody 58147
QQFNNYPYT

SEQ ID NO: 116294 - protein, 12 aa, Homo sapiens
  heavy chain complementarity determining region 3 for antibody 58147
ARVGRFAEFFDY

SEQ ID NO: 116295 - protein, 9 aa, Homo sapiens
  light chain complementarity determining region 3 for antibody 58148
QQFNNYPYT

SEQ ID NO: 116296 - protein, 14 aa, Homo sapiens
  heavy chain complementarity determining region 3 for antibody 58148
ARRFRIAVSAPFDY

SEQ ID NO: 116297 - protein, 9 aa, Homo sapiens
  light chain complementarity determining region 3 for antibody 58149
QQFNNYPYT

SEQ ID NO: 116298 - protein, 17 aa, Homo sapiens
  heavy chain complementarity determining region 3 for antibody 58149
AREGYYYGSGSYYTFDS

SEQ ID NO: 116299 - protein, 9 aa, Homo sapiens
  light chain complementarity determining region 3 for antibody 58150
QQFNNYPRT

SEQ ID NO: 116300 - protein, 17 aa, Homo sapiens
  heavy chain complementarity determining region 3 for antibody 58150
AREHIVVVAAINDAFDI

SEQ ID NO: 116301 - protein, 9 aa, Homo sapiens
  light chain complementarity determining region 3 for antibody 58151
QQFNNYPLT

SEQ ID NO: 116302 - protein, 11 aa, Homo sapiens
  heavy chain complementarity determining region 3 for antibody 58151
ARCNWNDSFDY

SEQ ID NO: 116303 - protein, 9 aa, Homo sapiens
  light chain complementarity determining region 3 for antibody 58152
QQFNNYPLT

SEQ ID NO: 116304 - protein, 11 aa, Homo sapiens
  heavy chain complementarity determining region 3 for antibody 58152
ARCNWNDDFDY

SEQ ID NO: 116305 - protein, 9 aa, Homo sapiens
  light chain complementarity determining region 3 for antibody 58153
QQFNNYPLT

SEQ ID NO: 116306 - protein, 22 aa, Homo sapiens
  heavy chain complementarity determining region 3 for antibody 58153
AKQSHYYDAESYRHYYYYGMDV

SEQ ID NO: 116307 - protein, 9 aa, Homo sapiens
  light chain complementarity determining region 3 for antibody 58154
QQFNNYPLT

SEQ ID NO: 116308 - protein, 17 aa, Homo sapiens
  heavy chain complementarity determining region 3 for antibody 58154
AKAMVRGVHSHHYGMDV

SEQ ID NO: 116309 - protein, 9 aa, Homo sapiens
  light chain complementarity determining region 3 for antibody 58155
QQFNNYPHT

SEQ ID NO: 116310 - protein, 18 aa, Homo sapiens
  heavy chain complementarity determining region 3 for antibody 58155
ARVWFGELPYSYYYGMDV

SEQ ID NO: 116311 - protein, 9 aa, Homo sapiens
  light chain complementarity determining region 3 for antibody 58156
QQFNIYPYT

SEQ ID NO: 116312 - protein, 14 aa, Homo sapiens
  heavy chain complementarity determining region 3 for antibody 58156
AGRSRIAVAAPFDY

SEQ ID NO: 116313 - protein, 8 aa, Homo sapiens
  light chain complementarity determining region 3 for antibody 58157
QQFNDYYT

SEQ ID NO: 116314 - protein, 10 aa, Homo sapiens
  heavy chain complementarity determining region 3 for antibody 58157
ARSNSGRFDY

SEQ ID NO: 116315 - protein, 9 aa, Homo sapiens
  light chain complementarity determining region 3 for antibody 58158
QQDYNLPLT

SEQ ID NO: 116316 - protein, 10 aa, Homo sapiens
  heavy chain complementarity determining region 3 for antibody 58158
AREGTSGFDY

SEQ ID NO: 116317 - protein, 9 aa, Homo sapiens
  light chain complementarity determining region 3 for antibody 58159
QQDYNLPLT

SEQ ID NO: 116318 - protein, 17 aa, Homo sapiens
  heavy chain complementarity determining region 3 for antibody 58159
ARDRLPPYYDILTALDV

SEQ ID NO: 116319 - protein, 8 aa, Homo sapiens
  light chain complementarity determining region 3 for antibody 58160
QQDSNLRT

SEQ ID NO: 116320 - protein, 17 aa, Homo sapiens
  heavy chain complementarity determining region 3 for antibody 58160
AREGYGDYGGYYYGMDV

SEQ ID NO: 116321 - protein, 9 aa, Homo sapiens
  light chain complementarity determining region 3 for antibody 58161
QQCYSTPRT

SEQ ID NO: 116322 - protein, 20 aa, Homo sapiens
  heavy chain complementarity determining region 3 for antibody 58161
ARDAGVWFVGPYYYYNGMDV

SEQ ID NO: 116323 - protein, 9 aa, Homo sapiens
  light chain complementarity determining region 3 for antibody 58162
QQCYSTPRT

SEQ ID NO: 116324 - protein, 20 aa, Homo sapiens
  heavy chain complementarity determining region 3 for antibody 58162
ARDAGVWFVDPYYYYDGMDV

SEQ ID NO: 116325 - protein, 9 aa, Homo sapiens
  light chain complementarity determining region 3 for antibody 58163
QQCYSTPRT

SEQ ID NO: 116326 - protein, 20 aa, Homo sapiens
  heavy chain complementarity determining region 3 for antibody 58163
ARDAGVWFVDPYYSYNGMDV

SEQ ID NO: 116327 - protein, 9 aa, Homo sapiens
  light chain complementarity determining region 3 for antibody 58164
QQCYSTPRT

SEQ ID NO: 116328 - protein, 20 aa, Homo sapiens
  heavy chain complementarity determining region 3 for antibody 58164
ARDAGVWFVDPYYFYNGMDV

SEQ ID NO: 116329 - protein, 9 aa, Homo sapiens
  light chain complementarity determining region 3 for antibody 58165
QQCYSTPRT

SEQ ID NO: 116330 - protein, 20 aa, Homo sapiens
  heavy chain complementarity determining region 3 for antibody 58165
ARDAGVWFVAPYYYYNGMDV

SEQ ID NO: 116331 - protein, 10 aa, Homo sapiens
  light chain complementarity determining region 3 for antibody 58166
QQCGSSPPYT

SEQ ID NO: 116332 - protein, 12 aa, Homo sapiens
  heavy chain complementarity determining region 3 for antibody 58166
TADYYSYYGMDV

SEQ ID NO: 116333 - protein, 9 aa, Homo sapiens
  light chain complementarity determining region 3 for antibody 58167
QKYNSSPWT

SEQ ID NO: 116334 - protein, 15 aa, Homo sapiens
  heavy chain complementarity determining region 3 for antibody 58167
AKAGDYYGSGSPFDY

SEQ ID NO: 116335 - protein, 9 aa, Homo sapiens
  light chain complementarity determining region 3 for antibody 58168
QKYNSDPWT

SEQ ID NO: 116336 - protein, 15 aa, Homo sapiens
  heavy chain complementarity determining region 3 for antibody 58168
AKAGDYYGSGSPFDY

SEQ ID NO: 116337 - protein, 9 aa, Homo sapiens
  light chain complementarity determining region 3 for antibody 58169
QKYNSAPWT

SEQ ID NO: 116338 - protein, 15 aa, Homo sapiens
  heavy chain complementarity determining region 3 for antibody 58169
AKAGGYYGSGSPFDY

SEQ ID NO: 116339 - protein, 9 aa, Homo sapiens
  light chain complementarity determining region 3 for antibody 58170
QKYNSAPWT

SEQ ID NO: 116340 - protein, 15 aa, Homo sapiens
  heavy chain complementarity determining region 3 for antibody 58170
AKAGEYYGSGRPFDY

SEQ ID NO: 116341 - protein, 9 aa, Homo sapiens
  light chain complementarity determining region 3 for antibody 58171
QKYNSAPWT

SEQ ID NO: 116342 - protein, 15 aa, Homo sapiens
  heavy chain complementarity determining region 3 for antibody 58171
AKAGDYYVSGSPFDY

SEQ ID NO: 116343 - protein, 9 aa, Homo sapiens
  light chain complementarity determining region 3 for antibody 58172
QKYNSAPWT

SEQ ID NO: 116344 - protein, 15 aa, Homo sapiens
  heavy chain complementarity determining region 3 for antibody 58172
AKAGDYYSSGSPFDY

SEQ ID NO: 116345 - protein, 9 aa, Homo sapiens
  light chain complementarity determining region 3 for antibody 58173
QKYNSAPWT

SEQ ID NO: 116346 - protein, 15 aa, Homo sapiens
  heavy chain complementarity determining region 3 for antibody 58173
AKAGDYYGTGSPFDY

SEQ ID NO: 116347 - protein, 9 aa, Homo sapiens
  light chain complementarity determining region 3 for antibody 58174
QKYNSAPWT

SEQ ID NO: 116348 - protein, 15 aa, Homo sapiens
  heavy chain complementarity determining region 3 for antibody 58174
AKAGDYYGSGSPVDY

SEQ ID NO: 116349 - protein, 9 aa, Homo sapiens
  light chain complementarity determining region 3 for antibody 58175
QKYNSAPWT

SEQ ID NO: 116350 - protein, 15 aa, Homo sapiens
  heavy chain complementarity determining region 3 for antibody 58175
AKAGDYYGSGRPFDD

SEQ ID NO: 116351 - protein, 9 aa, Homo sapiens
  light chain complementarity determining region 3 for antibody 58176
QKYNSAPWT

SEQ ID NO: 116352 - protein, 15 aa, Homo sapiens
  heavy chain complementarity determining region 3 for antibody 58176
AKAGDYYGSGRAFDY

SEQ ID NO: 116353 - protein, 9 aa, Homo sapiens
  light chain complementarity determining region 3 for antibody 58177
QKYNSAPWT

SEQ ID NO: 116354 - protein, 15 aa, Homo sapiens
  heavy chain complementarity determining region 3 for antibody 58177
AKAGDYYGSARPFDY

SEQ ID NO: 116355 - protein, 9 aa, Homo sapiens
  light chain complementarity determining region 3 for antibody 58178
QKYNSAPWT

SEQ ID NO: 116356 - protein, 15 aa, Homo sapiens
  heavy chain complementarity determining region 3 for antibody 58178
AKAGDYYGAGGPFDY

SEQ ID NO: 116357 - protein, 9 aa, Homo sapiens
  light chain complementarity determining region 3 for antibody 58179
QKYNSAPWT

SEQ ID NO: 116358 - protein, 15 aa, Homo sapiens
  heavy chain complementarity determining region 3 for antibody 58179
AKAGDYDGSGSPLDY

SEQ ID NO: 116359 - protein, 9 aa, Homo sapiens
  light chain complementarity determining region 3 for antibody 58180
QKYNSAPWT

SEQ ID NO: 116360 - protein, 15 aa, Homo sapiens
  heavy chain complementarity determining region 3 for antibody 58180
AKAGDFYGSGRPFDY

SEQ ID NO: 116361 - protein, 9 aa, Homo sapiens
  light chain complementarity determining region 3 for antibody 58181
QKYNSAPWT

SEQ ID NO: 116362 - protein, 15 aa, Homo sapiens
  heavy chain complementarity determining region 3 for antibody 58181
AKAGDDYGSGRPFDY

SEQ ID NO: 116363 - protein, 9 aa, Homo sapiens
  light chain complementarity determining region 3 for antibody 58182
QKYNSAPWT

SEQ ID NO: 116364 - protein, 15 aa, Homo sapiens
  heavy chain complementarity determining region 3 for antibody 58182
AKAGDCYGSWSPFDY

SEQ ID NO: 116365 - protein, 9 aa, Homo sapiens
  light chain complementarity determining region 3 for antibody 58183
QKYNSAPWT

SEQ ID NO: 116366 - protein, 15 aa, Homo sapiens
  heavy chain complementarity determining region 3 for antibody 58183
AKAGDCYGAGSPFDY

SEQ ID NO: 116367 - protein, 9 aa, Homo sapiens
  light chain complementarity determining region 3 for antibody 58184
QKYNSAPWT

SEQ ID NO: 116368 - protein, 15 aa, Homo sapiens
  heavy chain complementarity determining region 3 for antibody 58184
AKAGDCDGSGSPFDY

SEQ ID NO: 116369 - protein, 9 aa, Homo sapiens
  light chain complementarity determining region 3 for antibody 58185
QKYNSAPWT

SEQ ID NO: 116370 - protein, 15 aa, Homo sapiens
  heavy chain complementarity determining region 3 for antibody 58185
AEAGDYDGSGSPFDY

SEQ ID NO: 116371 - protein, 9 aa, Homo sapiens
  light chain complementarity determining region 3 for antibody 58186
QKYNSAPWP

SEQ ID NO: 116372 - protein, 15 aa, Homo sapiens
  heavy chain complementarity determining region 3 for antibody 58186
AKAGDYYGSGSPFDY

SEQ ID NO: 116373 - protein, 9 aa, Homo sapiens
  light chain complementarity determining region 3 for antibody 58187
QKYNSAPRT

SEQ ID NO: 116374 - protein, 15 aa, Homo sapiens
  heavy chain complementarity determining region 3 for antibody 58187
AKAGDYYGSVSPFDY

SEQ ID NO: 116375 - protein, 9 aa, Homo sapiens
  light chain complementarity determining region 3 for antibody 58188
QKYNSAPRT

SEQ ID NO: 116376 - protein, 15 aa, Homo sapiens
  heavy chain complementarity determining region 3 for antibody 58188
AKAGDYYGAGSPFDY

SEQ ID NO: 116377 - protein, 9 aa, Homo sapiens
  light chain complementarity determining region 3 for antibody 58189
QKYNSAPLT

SEQ ID NO: 116378 - protein, 15 aa, Homo sapiens
  heavy chain complementarity determining region 3 for antibody 58189
AKAGDYYGSGSPFDY

SEQ ID NO: 116379 - protein, 9 aa, Homo sapiens
  light chain complementarity determining region 3 for antibody 58190
QKYNRAPWT

SEQ ID NO: 116380 - protein, 15 aa, Homo sapiens
  heavy chain complementarity determining region 3 for antibody 58190
AKAGDYYGSGSPFDY

SEQ ID NO: 116381 - protein, 9 aa, Homo sapiens
  light chain complementarity determining region 3 for antibody 58191
QKYNGAPWT

SEQ ID NO: 116382 - protein, 15 aa, Homo sapiens
  heavy chain complementarity determining region 3 for antibody 58191
AKAGDYYGSGSPSDY

SEQ ID NO: 116383 - protein, 9 aa, Homo sapiens
  light chain complementarity determining region 3 for antibody 58192
QKCNSAPWT

SEQ ID NO: 116384 - protein, 15 aa, Homo sapiens
  heavy chain complementarity determining region 3 for antibody 58192
AKAGDYYGSGSPLDY

SEQ ID NO: 116385 - protein, 9 aa, Homo sapiens
  light chain complementarity determining region 3 for antibody 58193
PQDYNYPWT

SEQ ID NO: 116386 - protein, 17 aa, Homo sapiens
  heavy chain complementarity determining region 3 for antibody 58193
APVLRYFDWLFPNWFDP

SEQ ID NO: 116387 - protein, 9 aa, Homo sapiens
  light chain complementarity determining region 3 for antibody 58194
NQSSSLPHT

SEQ ID NO: 116388 - protein, 13 aa, Homo sapiens
  heavy chain complementarity determining region 3 for antibody 58194
ARGGYYGSGSLDY

SEQ ID NO: 116389 - protein, 9 aa, Homo sapiens
  light chain complementarity determining region 3 for antibody 58195
LQQNSYPFT

SEQ ID NO: 116390 - protein, 10 aa, Homo sapiens
  heavy chain complementarity determining region 3 for antibody 58195
ARDSSGWLDY

SEQ ID NO: 116391 - protein, 9 aa, Homo sapiens
  light chain complementarity determining region 3 for antibody 58196
LQHNSYPYT

SEQ ID NO: 116392 - protein, 12 aa, Homo sapiens
  heavy chain complementarity determining region 3 for antibody 58196
GKDRSYYYGMDV

SEQ ID NO: 116393 - protein, 9 aa, Homo sapiens
  light chain complementarity determining region 3 for antibody 58197
LQHNSYPYT

SEQ ID NO: 116394 - protein, 14 aa, Homo sapiens
  heavy chain complementarity determining region 3 for antibody 58197
ARGLRYFDWLAQDY

SEQ ID NO: 116395 - protein, 9 aa, Homo sapiens
  light chain complementarity determining region 3 for antibody 58198
LQHNSYPYT

SEQ ID NO: 116396 - protein, 22 aa, Homo sapiens
  heavy chain complementarity determining region 3 for antibody 58198
AREGDILAGYYNVRYYYYGMDV

SEQ ID NO: 116397 - protein, 9 aa, Homo sapiens
  light chain complementarity determining region 3 for antibody 58199
LQHNSYPYT

SEQ ID NO: 116398 - protein, 13 aa, Homo sapiens
  heavy chain complementarity determining region 3 for antibody 58199
ARDRLTGDLVFDY

SEQ ID NO: 116399 - protein, 9 aa, Homo sapiens
  light chain complementarity determining region 3 for antibody 58200
LQHNSYPYT

SEQ ID NO: 116400 - protein, 18 aa, Homo sapiens
  heavy chain complementarity determining region 3 for antibody 58200
APAGRDSGSYYYYYGMDV

SEQ ID NO: 116401 - protein, 9 aa, Homo sapiens
  light chain complementarity determining region 3 for antibody 58201
LQHNSYPYT

SEQ ID NO: 116402 - protein, 12 aa, Homo sapiens
  heavy chain complementarity determining region 3 for antibody 58201
AKDRSYYYVMDV

SEQ ID NO: 116403 - protein, 9 aa, Homo sapiens
  light chain complementarity determining region 3 for antibody 58202
LQHNSYPYT

SEQ ID NO: 116404 - protein, 12 aa, Homo sapiens
  heavy chain complementarity determining region 3 for antibody 58202
AKDRSYYYDMDV

SEQ ID NO: 116405 - protein, 9 aa, Homo sapiens
  light chain complementarity determining region 3 for antibody 58203
LQHNSYPYT

SEQ ID NO: 116406 - protein, 12 aa, Homo sapiens
  heavy chain complementarity determining region 3 for antibody 58203
AKDRSYYYAMDV

SEQ ID NO: 116407 - protein, 9 aa, Homo sapiens
  light chain complementarity determining region 3 for antibody 58204
LQHNSYPYT

SEQ ID NO: 116408 - protein, 12 aa, Homo sapiens
  heavy chain complementarity determining region 3 for antibody 58204
AKDRSSSYGMDV

SEQ ID NO: 116409 - protein, 9 aa, Homo sapiens
  light chain complementarity determining region 3 for antibody 58205
LQHNSYPYT

SEQ ID NO: 116410 - protein, 12 aa, Homo sapiens
  heavy chain complementarity determining region 3 for antibody 58205
AKDRGYYYGMDV

SEQ ID NO: 116411 - protein, 9 aa, Homo sapiens
  light chain complementarity determining region 3 for antibody 58206
LQHNSYPYT

SEQ ID NO: 116412 - protein, 16 aa, Homo sapiens
  heavy chain complementarity determining region 3 for antibody 58206
AKDGSGSYYLSEYFQH

SEQ ID NO: 116413 - protein, 9 aa, Homo sapiens
  light chain complementarity determining region 3 for antibody 58207
LQHNSYPYT

SEQ ID NO: 116414 - protein, 16 aa, Homo sapiens
  heavy chain complementarity determining region 3 for antibody 58207
AKDGSGSYYFTEYFQH

SEQ ID NO: 116415 - protein, 9 aa, Homo sapiens
  light chain complementarity determining region 3 for antibody 58208
LQHNSYPYT

SEQ ID NO: 116416 - protein, 15 aa, Homo sapiens
  heavy chain complementarity determining region 3 for antibody 58208
AKAGDYYGSGSPFDY

SEQ ID NO: 116417 - protein, 9 aa, Homo sapiens
  light chain complementarity determining region 3 for antibody 58209
LQHNSYPYT

SEQ ID NO: 116418 - protein, 14 aa, Homo sapiens
  heavy chain complementarity determining region 3 for antibody 58209
AGGPYYYGSGAYYK

SEQ ID NO: 116419 - protein, 9 aa, Homo sapiens
  light chain complementarity determining region 3 for antibody 58210
LQHNSYPWT

SEQ ID NO: 116420 - protein, 20 aa, Homo sapiens
  heavy chain complementarity determining region 3 for antibody 58210
ATDTMVRGVIIEAYYYGMDV

SEQ ID NO: 116421 - protein, 9 aa, Homo sapiens
  light chain complementarity determining region 3 for antibody 58211
LQHNSYPWT

SEQ ID NO: 116422 - protein, 22 aa, Homo sapiens
  heavy chain complementarity determining region 3 for antibody 58211
ARDFPLYYDILTGYPSYHGMDV

SEQ ID NO: 116423 - protein, 9 aa, Homo sapiens
  light chain complementarity determining region 3 for antibody 58212
LQHNSYPRT

SEQ ID NO: 116424 - protein, 18 aa, Homo sapiens
  heavy chain complementarity determining region 3 for antibody 58212
ATPITGTTGSYYYYGMDV

SEQ ID NO: 116425 - protein, 9 aa, Homo sapiens
  light chain complementarity determining region 3 for antibody 58213
LQHNSYPRT

SEQ ID NO: 116426 - protein, 18 aa, Homo sapiens
  heavy chain complementarity determining region 3 for antibody 58213
ATPITGATGYYYYYGMDV

SEQ ID NO: 116427 - protein, 9 aa, Homo sapiens
  light chain complementarity determining region 3 for antibody 58214
LQHNSYPRT

SEQ ID NO: 116428 - protein, 18 aa, Homo sapiens
  heavy chain complementarity determining region 3 for antibody 58214
ATPIAGTTGYYYYYGMDV

SEQ ID NO: 116429 - protein, 9 aa, Homo sapiens
  light chain complementarity determining region 3 for antibody 58215
LQHNSYPRT

SEQ ID NO: 116430 - protein, 14 aa, Homo sapiens
  heavy chain complementarity determining region 3 for antibody 58215
ARDGSSWYRGAFDI

SEQ ID NO: 116431 - protein, 9 aa, Homo sapiens
  light chain complementarity determining region 3 for antibody 58216
LQHNSYPRT

SEQ ID NO: 116432 - protein, 18 aa, Homo sapiens
  heavy chain complementarity determining region 3 for antibody 58216
AAPITGTTGYSYYYGMDV

SEQ ID NO: 116433 - protein, 9 aa, Homo sapiens
  light chain complementarity determining region 3 for antibody 58217
LQHNSYPFT

SEQ ID NO: 116434 - protein, 10 aa, Homo sapiens
  heavy chain complementarity determining region 3 for antibody 58217
VRDSSGWLDY

SEQ ID NO: 116435 - protein, 9 aa, Homo sapiens
  light chain complementarity determining region 3 for antibody 58218
LQHNSYPFT

SEQ ID NO: 116436 - protein, 10 aa, Homo sapiens
  heavy chain complementarity determining region 3 for antibody 58218
ARYSSGWLDY

SEQ ID NO: 116437 - protein, 9 aa, Homo sapiens
  light chain complementarity determining region 3 for antibody 58219
LQHNSYPFT

SEQ ID NO: 116438 - protein, 10 aa, Homo sapiens
  heavy chain complementarity determining region 3 for antibody 58219
ARDSTGWLDY

SEQ ID NO: 116439 - protein, 9 aa, Homo sapiens
  light chain complementarity determining region 3 for antibody 58220
LQHNSYPFT

SEQ ID NO: 116440 - protein, 10 aa, Homo sapiens
  heavy chain complementarity determining region 3 for antibody 58220
ARDSSGWWDY

SEQ ID NO: 116441 - protein, 9 aa, Homo sapiens
  light chain complementarity determining region 3 for antibody 58221
LQHNSYPFT

SEQ ID NO: 116442 - protein, 10 aa, Homo sapiens
  heavy chain complementarity determining region 3 for antibody 58221
ARDSSCCLDY

SEQ ID NO: 116443 - protein, 9 aa, Homo sapiens
  light chain complementarity determining region 3 for antibody 58222
LQHNSYPFT

SEQ ID NO: 116444 - protein, 10 aa, Homo sapiens
  heavy chain complementarity determining region 3 for antibody 58222
ARDSSAWLDY

SEQ ID NO: 116445 - protein, 9 aa, Homo sapiens
  light chain complementarity determining region 3 for antibody 58223
LQHNSYPFT

SEQ ID NO: 116446 - protein, 10 aa, Homo sapiens
  heavy chain complementarity determining region 3 for antibody 58223
ARDSGGWLDY

SEQ ID NO: 116447 - protein, 9 aa, Homo sapiens
  light chain complementarity determining region 3 for antibody 58224
LQHNSYPFT

SEQ ID NO: 116448 - protein, 10 aa, Homo sapiens
  heavy chain complementarity determining region 3 for antibody 58224
ARDRSGWLDY

SEQ ID NO: 116449 - protein, 9 aa, Homo sapiens
  light chain complementarity determining region 3 for antibody 58225
LQHNSYPFT

SEQ ID NO: 116450 - protein, 10 aa, Homo sapiens
  heavy chain complementarity determining region 3 for antibody 58225
ARDITGWLDY

SEQ ID NO: 116451 - protein, 9 aa, Homo sapiens
  light chain complementarity determining region 3 for antibody 58226
LQHNSYPFT

SEQ ID NO: 116452 - protein, 10 aa, Homo sapiens
  heavy chain complementarity determining region 3 for antibody 58226
ARASSGCLDY

SEQ ID NO: 116453 - protein, 9 aa, Homo sapiens
  light chain complementarity determining region 3 for antibody 58227
LQHNSYPFT

SEQ ID NO: 116454 - protein, 10 aa, Homo sapiens
  heavy chain complementarity determining region 3 for antibody 58227
AIDSSGCLDY

SEQ ID NO: 116455 - protein, 9 aa, Homo sapiens
  light chain complementarity determining region 3 for antibody 58228
LQHNSYPFT

SEQ ID NO: 116456 - protein, 10 aa, Homo sapiens
  heavy chain complementarity determining region 3 for antibody 58228
AGDSSGCLDY

SEQ ID NO: 116457 - protein, 9 aa, Homo sapiens
  light chain complementarity determining region 3 for antibody 58229
LQHDNFPYT

SEQ ID NO: 116458 - protein, 13 aa, Homo sapiens
  heavy chain complementarity determining region 3 for antibody 58229
ARDQDYGSGGPDY

SEQ ID NO: 116459 - protein, 9 aa, Homo sapiens
  light chain complementarity determining region 3 for antibody 58230
LQHDNFPYT

SEQ ID NO: 116460 - protein, 18 aa, Homo sapiens
  heavy chain complementarity determining region 3 for antibody 58230
ARDGGITMVRGIPRGMDV

SEQ ID NO: 116461 - protein, 9 aa, Homo sapiens
  light chain complementarity determining region 3 for antibody 58231
LQHDNFPYT

SEQ ID NO: 116462 - protein, 18 aa, Homo sapiens
  heavy chain complementarity determining region 3 for antibody 58231
ARDGGITMVRAILRGMDV

SEQ ID NO: 116463 - protein, 9 aa, Homo sapiens
  light chain complementarity determining region 3 for antibody 58232
LQGYNYPWT

SEQ ID NO: 116464 - protein, 11 aa, Homo sapiens
  heavy chain complementarity determining region 3 for antibody 58232
ATGSPLLWFGD

SEQ ID NO: 116465 - protein, 9 aa, Homo sapiens
  light chain complementarity determining region 3 for antibody 58233
LQDYSYPYT

SEQ ID NO: 116466 - protein, 13 aa, Homo sapiens
  heavy chain complementarity determining region 3 for antibody 58233
AREWKLRGNYFDY

SEQ ID NO: 116467 - protein, 9 aa, Homo sapiens
  light chain complementarity determining region 3 for antibody 58234
LQDYSYPWT

SEQ ID NO: 116468 - protein, 10 aa, Homo sapiens
  heavy chain complementarity determining region 3 for antibody 58234
ATMTNVPFDY

SEQ ID NO: 116469 - protein, 9 aa, Homo sapiens
  light chain complementarity determining region 3 for antibody 58235
LQDYSYPWT

SEQ ID NO: 116470 - protein, 10 aa, Homo sapiens
  heavy chain complementarity determining region 3 for antibody 58235
AAMTNVAFDY

SEQ ID NO: 116471 - protein, 9 aa, Homo sapiens
  light chain complementarity determining region 3 for antibody 58236
LQDYNYPYT

SEQ ID NO: 116472 - protein, 13 aa, Homo sapiens
  heavy chain complementarity determining region 3 for antibody 58236
ASDYGDYVGAFDI

SEQ ID NO: 116473 - protein, 9 aa, Homo sapiens
  light chain complementarity determining region 3 for antibody 58237
LQDYNYPYT

SEQ ID NO: 116474 - protein, 15 aa, Homo sapiens
  heavy chain complementarity determining region 3 for antibody 58237
ARNPPVIAAAGPIDY

SEQ ID NO: 116475 - protein, 9 aa, Homo sapiens
  light chain complementarity determining region 3 for antibody 58238
LQDYNYPYT

SEQ ID NO: 116476 - protein, 16 aa, Homo sapiens
  heavy chain complementarity determining region 3 for antibody 58238
ARGYFGSGSSSRCFDP

SEQ ID NO: 116477 - protein, 9 aa, Homo sapiens
  light chain complementarity determining region 3 for antibody 58239
LQDYNYPYT

SEQ ID NO: 116478 - protein, 13 aa, Homo sapiens
  heavy chain complementarity determining region 3 for antibody 58239
ARGGYYGSGSLDY

SEQ ID NO: 116479 - protein, 9 aa, Homo sapiens
  light chain complementarity determining region 3 for antibody 58240
LQDYNYPYT

SEQ ID NO: 116480 - protein, 18 aa, Homo sapiens
  heavy chain complementarity determining region 3 for antibody 58240
ARGAWYCYGSGSYYTFDY

SEQ ID NO: 116481 - protein, 9 aa, Homo sapiens
  light chain complementarity determining region 3 for antibody 58241
LQDYNYPYT

SEQ ID NO: 116482 - protein, 17 aa, Homo sapiens
  heavy chain complementarity determining region 3 for antibody 58241
ARFDYYGSGSYGGCFDY

SEQ ID NO: 116483 - protein, 9 aa, Homo sapiens
  light chain complementarity determining region 3 for antibody 58242
LQDYNYPYT

SEQ ID NO: 116484 - protein, 17 aa, Homo sapiens
  heavy chain complementarity determining region 3 for antibody 58242
ARELRYFDGLLADAFDI

SEQ ID NO: 116485 - protein, 9 aa, Homo sapiens
  light chain complementarity determining region 3 for antibody 58243
LQDYNYPYT

SEQ ID NO: 116486 - protein, 22 aa, Homo sapiens
  heavy chain complementarity determining region 3 for antibody 58243
AREAPLLRLETLSYGGYYGMDV

SEQ ID NO: 116487 - protein, 9 aa, Homo sapiens
  light chain complementarity determining region 3 for antibody 58244
LQDYNYPYT

SEQ ID NO: 116488 - protein, 22 aa, Homo sapiens
  heavy chain complementarity determining region 3 for antibody 58244
ARDVRDYDDLTGYYNGGNSFDY

SEQ ID NO: 116489 - protein, 9 aa, Homo sapiens
  light chain complementarity determining region 3 for antibody 58245
LQDYNYPYT

SEQ ID NO: 116490 - protein, 22 aa, Homo sapiens
  heavy chain complementarity determining region 3 for antibody 58245
ARDVRDYDDLTGYYNGGDYFDY

SEQ ID NO: 116491 - protein, 9 aa, Homo sapiens
  light chain complementarity determining region 3 for antibody 58246
LQDYNYPYT

SEQ ID NO: 116492 - protein, 15 aa, Homo sapiens
  heavy chain complementarity determining region 3 for antibody 58246
ARDPPVIAAAGTIDY

SEQ ID NO: 116493 - protein, 9 aa, Homo sapiens
  light chain complementarity determining region 3 for antibody 58247
LQDYNYPYT

SEQ ID NO: 116494 - protein, 11 aa, Homo sapiens
  heavy chain complementarity determining region 3 for antibody 58247
ARDAYGSGLDV

SEQ ID NO: 116495 - protein, 9 aa, Homo sapiens
  light chain complementarity determining region 3 for antibody 58248
LQDYNYPYT

SEQ ID NO: 116496 - protein, 17 aa, Homo sapiens
  heavy chain complementarity determining region 3 for antibody 58248
ARCDYYGSGSYGGFFDY

SEQ ID NO: 116497 - protein, 9 aa, Homo sapiens
  light chain complementarity determining region 3 for antibody 58249
LQDYNYPYT

SEQ ID NO: 116498 - protein, 18 aa, Homo sapiens
  heavy chain complementarity determining region 3 for antibody 58249
AKSDWNDVDYYYFYGMDV

SEQ ID NO: 116499 - protein, 9 aa, Homo sapiens
  light chain complementarity determining region 3 for antibody 58250
LQDYNYPYT

SEQ ID NO: 116500 - protein, 15 aa, Homo sapiens
  heavy chain complementarity determining region 3 for antibody 58250
AKDRYYYGSGRPMDV

SEQ ID NO: 116501 - protein, 9 aa, Homo sapiens
  light chain complementarity determining region 3 for antibody 58251
LQDYNYPYT

SEQ ID NO: 116502 - protein, 15 aa, Homo sapiens
  heavy chain complementarity determining region 3 for antibody 58251
AKDRYYYGSASPMDV

SEQ ID NO: 116503 - protein, 9 aa, Homo sapiens
  light chain complementarity determining region 3 for antibody 58252
LQDYNYPYT

SEQ ID NO: 116504 - protein, 15 aa, Homo sapiens
  heavy chain complementarity determining region 3 for antibody 58252
AKDRYSYGSASPMDV

SEQ ID NO: 116505 - protein, 9 aa, Homo sapiens
  light chain complementarity determining region 3 for antibody 58253
LQDYNYPYT

SEQ ID NO: 116506 - protein, 15 aa, Homo sapiens
  heavy chain complementarity determining region 3 for antibody 58253
AKAGDYYGSGSPFDY

SEQ ID NO: 116507 - protein, 9 aa, Homo sapiens
  light chain complementarity determining region 3 for antibody 58254
LQDYNYPYT

SEQ ID NO: 116508 - protein, 18 aa, Homo sapiens
  heavy chain complementarity determining region 3 for antibody 58254
AGGAWYYYGSGSYYAFDY

SEQ ID NO: 116509 - protein, 9 aa, Homo sapiens
  light chain complementarity determining region 3 for antibody 58255
LQDYNYPYT

SEQ ID NO: 116510 - protein, 18 aa, Homo sapiens
  heavy chain complementarity determining region 3 for antibody 58255
AGGAWYDYGSGSYYTFDY

SEQ ID NO: 116511 - protein, 9 aa, Homo sapiens
  light chain complementarity determining region 3 for antibody 58256
LQDYNYPWT

SEQ ID NO: 116512 - protein, 11 aa, Homo sapiens
  heavy chain complementarity determining region 3 for antibody 58256
ATGSPLLWFRD

SEQ ID NO: 116513 - protein, 9 aa, Homo sapiens
  light chain complementarity determining region 3 for antibody 58257
LQDYNYPWT

SEQ ID NO: 116514 - protein, 13 aa, Homo sapiens
  heavy chain complementarity determining region 3 for antibody 58257
ARVRITGPYAFDI

SEQ ID NO: 116515 - protein, 9 aa, Homo sapiens
  light chain complementarity determining region 3 for antibody 58258
LQDYNYPWT

SEQ ID NO: 116516 - protein, 19 aa, Homo sapiens
  heavy chain complementarity determining region 3 for antibody 58258
ARGPPLFSSSWPEDYGMDV

SEQ ID NO: 116517 - protein, 9 aa, Homo sapiens
  light chain complementarity determining region 3 for antibody 58259
LQDYNYPWT

SEQ ID NO: 116518 - protein, 14 aa, Homo sapiens
  heavy chain complementarity determining region 3 for antibody 58259
ARGLLWFGGYAMDV

SEQ ID NO: 116519 - protein, 9 aa, Homo sapiens
  light chain complementarity determining region 3 for antibody 58260
LQDYNYPWT

SEQ ID NO: 116520 - protein, 13 aa, Homo sapiens
  heavy chain complementarity determining region 3 for antibody 58260
ARGGYYGSGSLDY

SEQ ID NO: 116521 - protein, 9 aa, Homo sapiens
  light chain complementarity determining region 3 for antibody 58261
LQDYNYPWT

SEQ ID NO: 116522 - protein, 17 aa, Homo sapiens
  heavy chain complementarity determining region 3 for antibody 58261
ARGEGKLRYSDWLLGDY

SEQ ID NO: 116523 - protein, 9 aa, Homo sapiens
  light chain complementarity determining region 3 for antibody 58262
LQDYNYPWT

SEQ ID NO: 116524 - protein, 13 aa, Homo sapiens
  heavy chain complementarity determining region 3 for antibody 58262
AREYSGSDAHFDY

SEQ ID NO: 116525 - protein, 9 aa, Homo sapiens
  light chain complementarity determining region 3 for antibody 58263
LQDYNYPWT

SEQ ID NO: 116526 - protein, 13 aa, Homo sapiens
  heavy chain complementarity determining region 3 for antibody 58263
AREEVTWGAFFDY

SEQ ID NO: 116527 - protein, 9 aa, Homo sapiens
  light chain complementarity determining region 3 for antibody 58264
LQDYNYPWT

SEQ ID NO: 116528 - protein, 13 aa, Homo sapiens
  heavy chain complementarity determining region 3 for antibody 58264
AREEVNWGASFDY

SEQ ID NO: 116529 - protein, 9 aa, Homo sapiens
  light chain complementarity determining region 3 for antibody 58265
LQDYNYPWT

SEQ ID NO: 116530 - protein, 13 aa, Homo sapiens
  heavy chain complementarity determining region 3 for antibody 58265
AREEANWGAFFDY

SEQ ID NO: 116531 - protein, 9 aa, Homo sapiens
  light chain complementarity determining region 3 for antibody 58266
LQDYNYPWT

SEQ ID NO: 116532 - protein, 17 aa, Homo sapiens
  heavy chain complementarity determining region 3 for antibody 58266
ARDRLVRGVDYSYGMDV

SEQ ID NO: 116533 - protein, 9 aa, Homo sapiens
  light chain complementarity determining region 3 for antibody 58267
LQDYNYPWT

SEQ ID NO: 116534 - protein, 15 aa, Homo sapiens
  heavy chain complementarity determining region 3 for antibody 58267
ARDPYYSTNWSPFDY

SEQ ID NO: 116535 - protein, 9 aa, Homo sapiens
  light chain complementarity determining region 3 for antibody 58268
LQDYNYPWT

SEQ ID NO: 116536 - protein, 15 aa, Homo sapiens
  heavy chain complementarity determining region 3 for antibody 58268
ARDGGYSYGPDSFDI

SEQ ID NO: 116537 - protein, 9 aa, Homo sapiens
  light chain complementarity determining region 3 for antibody 58269
LQDYNYPWT

SEQ ID NO: 116538 - protein, 15 aa, Homo sapiens
  heavy chain complementarity determining region 3 for antibody 58269
ARDGGCSYGPDAFDI

SEQ ID NO: 116539 - protein, 9 aa, Homo sapiens
  light chain complementarity determining region 3 for antibody 58270
LQDYNYPWT

SEQ ID NO: 116540 - protein, 14 aa, Homo sapiens
  heavy chain complementarity determining region 3 for antibody 58270
AGRHYDTLTGFSDY

SEQ ID NO: 116541 - protein, 9 aa, Homo sapiens
  light chain complementarity determining region 3 for antibody 58271
LQDYNYPWT

SEQ ID NO: 116542 - protein, 14 aa, Homo sapiens
  heavy chain complementarity determining region 3 for antibody 58271
AGRHYDILTGVSDY

SEQ ID NO: 116543 - protein, 9 aa, Homo sapiens
  light chain complementarity determining region 3 for antibody 58272
LQDYNYPWT

SEQ ID NO: 116544 - protein, 14 aa, Homo sapiens
  heavy chain complementarity determining region 3 for antibody 58272
AGRHYDILAGFSDY

SEQ ID NO: 116545 - protein, 9 aa, Homo sapiens
  light chain complementarity determining region 3 for antibody 58273
LQDYNYPWT

SEQ ID NO: 116546 - protein, 14 aa, Homo sapiens
  heavy chain complementarity determining region 3 for antibody 58273
AGGLLWFGGYVMDV

SEQ ID NO: 116547 - protein, 9 aa, Homo sapiens
  light chain complementarity determining region 3 for antibody 58274
LQDYNYPWT

SEQ ID NO: 116548 - protein, 13 aa, Homo sapiens
  heavy chain complementarity determining region 3 for antibody 58274
AGEYSGYDAHFDY

SEQ ID NO: 116549 - protein, 9 aa, Homo sapiens
  light chain complementarity determining region 3 for antibody 58275
LQDYNYPRT

SEQ ID NO: 116550 - protein, 15 aa, Homo sapiens
  heavy chain complementarity determining region 3 for antibody 58275
ARVAWSGEWGDAFDI

SEQ ID NO: 116551 - protein, 9 aa, Homo sapiens
  light chain complementarity determining region 3 for antibody 58276
LQDYNYPRT

SEQ ID NO: 116552 - protein, 15 aa, Homo sapiens
  heavy chain complementarity determining region 3 for antibody 58276
AREDAMIRANWGFDP

SEQ ID NO: 116553 - protein, 9 aa, Homo sapiens
  light chain complementarity determining region 3 for antibody 58277
LQDYNYPRT

SEQ ID NO: 116554 - protein, 14 aa, Homo sapiens
  heavy chain complementarity determining region 3 for antibody 58277
ARDSYSGSGSYFDY

SEQ ID NO: 116555 - protein, 9 aa, Homo sapiens
  light chain complementarity determining region 3 for antibody 58278
LQDYNYPRT

SEQ ID NO: 116556 - protein, 11 aa, Homo sapiens
  heavy chain complementarity determining region 3 for antibody 58278
ARDSGYDPLDY

SEQ ID NO: 116557 - protein, 9 aa, Homo sapiens
  light chain complementarity determining region 3 for antibody 58279
LQDYNYPRT

SEQ ID NO: 116558 - protein, 15 aa, Homo sapiens
  heavy chain complementarity determining region 3 for antibody 58279
AGEDAMIRAKWGFDP

SEQ ID NO: 116559 - protein, 9 aa, Homo sapiens
  light chain complementarity determining region 3 for antibody 58280
LQDYNYPRA

SEQ ID NO: 116560 - protein, 20 aa, Homo sapiens
  heavy chain complementarity determining region 3 for antibody 58280
AKDGLWFGELLDYYYYGMDV

SEQ ID NO: 116561 - protein, 9 aa, Homo sapiens
  light chain complementarity determining region 3 for antibody 58281
LQDYNYPLT

SEQ ID NO: 116562 - protein, 10 aa, Homo sapiens
  heavy chain complementarity determining region 3 for antibody 58281
VSMTTVIFDY

SEQ ID NO: 116563 - protein, 9 aa, Homo sapiens
  light chain complementarity determining region 3 for antibody 58282
LQDYNYPLT

SEQ ID NO: 116564 - protein, 10 aa, Homo sapiens
  heavy chain complementarity determining region 3 for antibody 58282
VRMTTVSFDY

SEQ ID NO: 116565 - protein, 9 aa, Homo sapiens
  light chain complementarity determining region 3 for antibody 58283
LQDYNYPLT

SEQ ID NO: 116566 - protein, 10 aa, Homo sapiens
  heavy chain complementarity determining region 3 for antibody 58283
VRMATVIFDY

SEQ ID NO: 116567 - protein, 9 aa, Homo sapiens
  light chain complementarity determining region 3 for antibody 58284
LQDYNYPHT

SEQ ID NO: 116568 - protein, 15 aa, Homo sapiens
  heavy chain complementarity determining region 3 for antibody 58284
ARDQGVGRAAAGFDY

SEQ ID NO: 116569 - protein, 9 aa, Homo sapiens
  light chain complementarity determining region 3 for antibody 58285
LQDYNYPHT

SEQ ID NO: 116570 - protein, 10 aa, Homo sapiens
  heavy chain complementarity determining region 3 for antibody 58285
AISFAAPEDF

SEQ ID NO: 116571 - protein, 9 aa, Homo sapiens
  light chain complementarity determining region 3 for antibody 58286
LQDYNYLWT

SEQ ID NO: 116572 - protein, 11 aa, Homo sapiens
  heavy chain complementarity determining region 3 for antibody 58286
ATGSPLLWFGD

SEQ ID NO: 116573 - protein, 9 aa, Homo sapiens
  light chain complementarity determining region 3 for antibody 58287
LQDYNHPWT

SEQ ID NO: 116574 - protein, 14 aa, Homo sapiens
  heavy chain complementarity determining region 3 for antibody 58287
AGRHYDILTGFSDY

SEQ ID NO: 116575 - protein, 9 aa, Homo sapiens
  light chain complementarity determining region 3 for antibody 58288
LQAYNYPWT

SEQ ID NO: 116576 - protein, 14 aa, Homo sapiens
  heavy chain complementarity determining region 3 for antibody 58288
AGRYYDIFTGYHDY

SEQ ID NO: 116577 - protein, 9 aa, Homo sapiens
  light chain complementarity determining region 3 for antibody 58289
LHHNSYPRT

SEQ ID NO: 116578 - protein, 14 aa, Homo sapiens
  heavy chain complementarity determining region 3 for antibody 58289
ARDGSSWYRGAFDI

SEQ ID NO: 116579 - protein, 9 aa, Homo sapiens
  light chain complementarity determining region 3 for antibody 58290
KQYNNWPRT

SEQ ID NO: 116580 - protein, 17 aa, Homo sapiens
  heavy chain complementarity determining region 3 for antibody 58290
AEDIVVVTEEVYWYFDL

SEQ ID NO: 116581 - protein, 9 aa, Homo sapiens
  light chain complementarity determining region 3 for antibody 58291
HQYNSYPFT

SEQ ID NO: 116582 - protein, 13 aa, Homo sapiens
  heavy chain complementarity determining region 3 for antibody 58291
ARERWAANSCFDY

SEQ ID NO: 116583 - protein, 9 aa, Homo sapiens
  light chain complementarity determining region 3 for antibody 58292
HQYNSYPFT

SEQ ID NO: 116584 - protein, 13 aa, Homo sapiens
  heavy chain complementarity determining region 3 for antibody 58292
ARERGAANTCFDY

SEQ ID NO: 116585 - protein, 9 aa, Homo sapiens
  light chain complementarity determining region 3 for antibody 58293
HQSSSLPYT

SEQ ID NO: 116586 - protein, 13 aa, Homo sapiens
  heavy chain complementarity determining region 3 for antibody 58293
ARHSGSYGRSFDY

SEQ ID NO: 116587 - protein, 9 aa, Homo sapiens
  light chain complementarity determining region 3 for antibody 58294
HQSSSLPYT

SEQ ID NO: 116588 - protein, 17 aa, Homo sapiens
  heavy chain complementarity determining region 3 for antibody 58294
AREGDILTGYSPLYFDY

SEQ ID NO: 116589 - protein, 9 aa, Homo sapiens
  light chain complementarity determining region 3 for antibody 58295
HQSSSLPYT

SEQ ID NO: 116590 - protein, 15 aa, Homo sapiens
  heavy chain complementarity determining region 3 for antibody 58295
ARDGYSGYVLYYFDY

SEQ ID NO: 116591 - protein, 9 aa, Homo sapiens
  light chain complementarity determining region 3 for antibody 58296
HQSSSLPYT

SEQ ID NO: 116592 - protein, 11 aa, Homo sapiens
  heavy chain complementarity determining region 3 for antibody 58296
ARCNWNDDFDY

SEQ ID NO: 116593 - protein, 9 aa, Homo sapiens
  light chain complementarity determining region 3 for antibody 58297
HQSSSLPNT

SEQ ID NO: 116594 - protein, 13 aa, Homo sapiens
  heavy chain complementarity determining region 3 for antibody 58297
ARGGYYGSGSLDY

SEQ ID NO: 116595 - protein, 9 aa, Homo sapiens
  light chain complementarity determining region 3 for antibody 58298
HQSSSLPLT

SEQ ID NO: 116596 - protein, 14 aa, Homo sapiens
  heavy chain complementarity determining region 3 for antibody 58298
ARRGRVGGTSHFDY

SEQ ID NO: 116597 - protein, 9 aa, Homo sapiens
  light chain complementarity determining region 3 for antibody 58299
HQSSSLPLT

SEQ ID NO: 116598 - protein, 13 aa, Homo sapiens
  heavy chain complementarity determining region 3 for antibody 58299
ARGGYYVSGSLDY

SEQ ID NO: 116599 - protein, 9 aa, Homo sapiens
  light chain complementarity determining region 3 for antibody 58300
HQSSSLPLT

SEQ ID NO: 116600 - protein, 13 aa, Homo sapiens
  heavy chain complementarity determining region 3 for antibody 58300
ARGGYYGSWSLDY

SEQ ID NO: 116601 - protein, 9 aa, Homo sapiens
  light chain complementarity determining region 3 for antibody 58301
HQSSSLPLT

SEQ ID NO: 116602 - protein, 13 aa, Homo sapiens
  heavy chain complementarity determining region 3 for antibody 58301
ARGGYCGSGSLDY

SEQ ID NO: 116603 - protein, 9 aa, Homo sapiens
  light chain complementarity determining region 3 for antibody 58302
HQSSSLPLT

SEQ ID NO: 116604 - protein, 13 aa, Homo sapiens
  heavy chain complementarity determining region 3 for antibody 58302
ARGGHYGSGSLDY

SEQ ID NO: 116605 - protein, 9 aa, Homo sapiens
  light chain complementarity determining region 3 for antibody 58303
HQSSSLPLT

SEQ ID NO: 116606 - protein, 13 aa, Homo sapiens
  heavy chain complementarity determining region 3 for antibody 58303
ARGGDYGSGSLDY

SEQ ID NO: 116607 - protein, 9 aa, Homo sapiens
  light chain complementarity determining region 3 for antibody 58304
HQSSSLPLT

SEQ ID NO: 116608 - protein, 16 aa, Homo sapiens
  heavy chain complementarity determining region 3 for antibody 58304
AREPLYDISTYDAFDI

SEQ ID NO: 116609 - protein, 9 aa, Homo sapiens
  light chain complementarity determining region 3 for antibody 58305
HQSSSLPLT

SEQ ID NO: 116610 - protein, 13 aa, Homo sapiens
  heavy chain complementarity determining region 3 for antibody 58305
AGGGYYGSGGLDY

SEQ ID NO: 116611 - protein, 9 aa, Homo sapiens
  light chain complementarity determining region 3 for antibody 58306
HQSSSLPHT

SEQ ID NO: 116612 - protein, 13 aa, Homo sapiens
  heavy chain complementarity determining region 3 for antibody 58306
ASGGYYGSGSLDY

SEQ ID NO: 116613 - protein, 9 aa, Homo sapiens
  light chain complementarity determining region 3 for antibody 58307
HQSSSLPHT

SEQ ID NO: 116614 - protein, 13 aa, Homo sapiens
  heavy chain complementarity determining region 3 for antibody 58307
ARGGYYVSGSIDY

SEQ ID NO: 116615 - protein, 9 aa, Homo sapiens
  light chain complementarity determining region 3 for antibody 58308
HQSSSLPHT

SEQ ID NO: 116616 - protein, 13 aa, Homo sapiens
  heavy chain complementarity determining region 3 for antibody 58308
ARGGYYVSGGLDY

SEQ ID NO: 116617 - protein, 9 aa, Homo sapiens
  light chain complementarity determining region 3 for antibody 58309
HQSSSLPHT

SEQ ID NO: 116618 - protein, 13 aa, Homo sapiens
  heavy chain complementarity determining region 3 for antibody 58309
ARGGYYGSVSLDY

SEQ ID NO: 116619 - protein, 9 aa, Homo sapiens
  light chain complementarity determining region 3 for antibody 58310
HQSSSLPHT

SEQ ID NO: 116620 - protein, 13 aa, Homo sapiens
  heavy chain complementarity determining region 3 for antibody 58310
ARGGYYGSRSLDY

SEQ ID NO: 116621 - protein, 9 aa, Homo sapiens
  light chain complementarity determining region 3 for antibody 58311
HQSSSLPHT

SEQ ID NO: 116622 - protein, 13 aa, Homo sapiens
  heavy chain complementarity determining region 3 for antibody 58311
ARGGYYGSGSLEC

SEQ ID NO: 116623 - protein, 9 aa, Homo sapiens
  light chain complementarity determining region 3 for antibody 58312
HQSSSLPHT

SEQ ID NO: 116624 - protein, 13 aa, Homo sapiens
  heavy chain complementarity determining region 3 for antibody 58312
ARGGYYGSGSIDD

SEQ ID NO: 116625 - protein, 9 aa, Homo sapiens
  light chain complementarity determining region 3 for antibody 58313
HQSSSLPHT

SEQ ID NO: 116626 - protein, 13 aa, Homo sapiens
  heavy chain complementarity determining region 3 for antibody 58313
ARGGYYGSGSHDY

SEQ ID NO: 116627 - protein, 9 aa, Homo sapiens
  light chain complementarity determining region 3 for antibody 58314
HQSSSLPHT

SEQ ID NO: 116628 - protein, 13 aa, Homo sapiens
  heavy chain complementarity determining region 3 for antibody 58314
ARGGYYGSGGLDC

SEQ ID NO: 116629 - protein, 9 aa, Homo sapiens
  light chain complementarity determining region 3 for antibody 58315
HQSSSLPHT

SEQ ID NO: 116630 - protein, 13 aa, Homo sapiens
  heavy chain complementarity determining region 3 for antibody 58315
ARGGYYGSASLDY

SEQ ID NO: 116631 - protein, 9 aa, Homo sapiens
  light chain complementarity determining region 3 for antibody 58316
HQSSSLPHT

SEQ ID NO: 116632 - protein, 13 aa, Homo sapiens
  heavy chain complementarity determining region 3 for antibody 58316
ARGGYDGSGGLDY

SEQ ID NO: 116633 - protein, 9 aa, Homo sapiens
  light chain complementarity determining region 3 for antibody 58317
HQSSSLPHT

SEQ ID NO: 116634 - protein, 13 aa, Homo sapiens
  heavy chain complementarity determining region 3 for antibody 58317
ARGGSYGSGSIDY

SEQ ID NO: 116635 - protein, 9 aa, Homo sapiens
  light chain complementarity determining region 3 for antibody 58318
HQSSSLPHT

SEQ ID NO: 116636 - protein, 13 aa, Homo sapiens
  heavy chain complementarity determining region 3 for antibody 58318
ARGGDYGSGRLDY

SEQ ID NO: 116637 - protein, 9 aa, Homo sapiens
  light chain complementarity determining region 3 for antibody 58319
HQSSSLPHT

SEQ ID NO: 116638 - protein, 22 aa, Homo sapiens
  heavy chain complementarity determining region 3 for antibody 58319
ARDFPLYYDILIGYPYYHGMDV

SEQ ID NO: 116639 - protein, 9 aa, Homo sapiens
  light chain complementarity determining region 3 for antibody 58320
HQSSSLPHT

SEQ ID NO: 116640 - protein, 13 aa, Homo sapiens
  heavy chain complementarity determining region 3 for antibody 58320
AGGGSYGSGSLDY

SEQ ID NO: 116641 - protein, 9 aa, Homo sapiens
  light chain complementarity determining region 3 for antibody 58321
HQSSSLPHT

SEQ ID NO: 116642 - protein, 13 aa, Homo sapiens
  heavy chain complementarity determining region 3 for antibody 58321
AGGGCYGSGSLDY

SEQ ID NO: 116643 - protein, 9 aa, Homo sapiens
  light chain complementarity determining region 3 for antibody 58322
HQSSRLPHT

SEQ ID NO: 116644 - protein, 15 aa, Homo sapiens
  heavy chain complementarity determining region 3 for antibody 58322
ARDYYGSGRYYGMDV

SEQ ID NO: 116645 - protein, 9 aa, Homo sapiens
  light chain complementarity determining region 3 for antibody 58323
RQYNNWPLT

SEQ ID NO: 116646 - protein, 18 aa, Homo sapiens
  heavy chain complementarity determining region 3 for antibody 58323
TRDLRPPGIAVAEGAFDI

SEQ ID NO: 116647 - protein, 9 aa, Homo sapiens
  light chain complementarity determining region 3 for antibody 58324
RQLNSYPLT

SEQ ID NO: 116648 - protein, 12 aa, Homo sapiens
  heavy chain complementarity determining region 3 for antibody 58324
ARMVRGVIPFDY

SEQ ID NO: 116649 - protein, 9 aa, Homo sapiens
  light chain complementarity determining region 3 for antibody 58325
RKYNSAPWT

SEQ ID NO: 116650 - protein, 15 aa, Homo sapiens
  heavy chain complementarity determining region 3 for antibody 58325
AKAGDYYGSGSPSDY

SEQ ID NO: 116651 - protein, 9 aa, Homo sapiens
  light chain complementarity determining region 3 for antibody 58326
QTYNSAPWT

SEQ ID NO: 116652 - protein, 15 aa, Homo sapiens
  heavy chain complementarity determining region 3 for antibody 58326
AKAGDYYGSGSPFDY

SEQ ID NO: 116653 - protein, 8 aa, Homo sapiens
  light chain complementarity determining region 3 for antibody 58327
QRYNSAYT

SEQ ID NO: 116654 - protein, 11 aa, Homo sapiens
  heavy chain complementarity determining region 3 for antibody 58327
ARPRYSGTYGY

SEQ ID NO: 116655 - protein, 9 aa, Homo sapiens
  light chain complementarity determining region 3 for antibody 58328
QRTYNAPYT

SEQ ID NO: 116656 - protein, 18 aa, Homo sapiens
  heavy chain complementarity determining region 3 for antibody 58328
ARDVIAAAGTDYYYGMDV

SEQ ID NO: 116657 - protein, 9 aa, Homo sapiens
  light chain complementarity determining region 3 for antibody 58329
QRTYNAPYT

SEQ ID NO: 116658 - protein, 18 aa, Homo sapiens
  heavy chain complementarity determining region 3 for antibody 58329
ARDMIAAAGTDFYYGMDV

SEQ ID NO: 116659 - protein, 9 aa, Homo sapiens
  light chain complementarity determining region 3 for antibody 58330
QQYYSYPYT

SEQ ID NO: 116660 - protein, 16 aa, Homo sapiens
  heavy chain complementarity determining region 3 for antibody 58330
TTGVAGPKPYYYGLDV

SEQ ID NO: 116661 - protein, 9 aa, Homo sapiens
  light chain complementarity determining region 3 for antibody 58331
QQYYSYPWT

SEQ ID NO: 116662 - protein, 9 aa, Homo sapiens
  heavy chain complementarity determining region 3 for antibody 58331
ASGWGYKDY

SEQ ID NO: 116663 - protein, 9 aa, Homo sapiens
  light chain complementarity determining region 3 for antibody 58332
QQYSSYPFT

SEQ ID NO: 116664 - protein, 12 aa, Homo sapiens
  heavy chain complementarity determining region 3 for antibody 58332
ARRGYGNYELDY

SEQ ID NO: 116665 - protein, 9 aa, Homo sapiens
  light chain complementarity determining region 3 for antibody 58333
QQYSNWPLT

SEQ ID NO: 116666 - protein, 18 aa, Homo sapiens
  heavy chain complementarity determining region 3 for antibody 58333
TRDLRPPGIAVAEGAFDI

SEQ ID NO: 116667 - protein, 9 aa, Homo sapiens
  light chain complementarity determining region 3 for antibody 58334
QQYNSYSYT

SEQ ID NO: 116668 - protein, 15 aa, Homo sapiens
  heavy chain complementarity determining region 3 for antibody 58334
ATGVRGVPNSYGLDV

SEQ ID NO: 116669 - protein, 9 aa, Homo sapiens
  light chain complementarity determining region 3 for antibody 58335
QQYNSYSYT

SEQ ID NO: 116670 - protein, 15 aa, Homo sapiens
  heavy chain complementarity determining region 3 for antibody 58335
ATGVPGVPNYYGLDV

SEQ ID NO: 116671 - protein, 9 aa, Homo sapiens
  light chain complementarity determining region 3 for antibody 58336
QQYNSYSWT

SEQ ID NO: 116672 - protein, 16 aa, Homo sapiens
  heavy chain complementarity determining region 3 for antibody 58336
ARDPLYFDWLRDAFDI

SEQ ID NO: 116673 - protein, 9 aa, Homo sapiens
  light chain complementarity determining region 3 for antibody 58337
QQYNSYSRT

SEQ ID NO: 116674 - protein, 13 aa, Homo sapiens
  heavy chain complementarity determining region 3 for antibody 58337
AAHYGDYAHYFDY

SEQ ID NO: 116675 - protein, 9 aa, Homo sapiens
  light chain complementarity determining region 3 for antibody 58338
QQYNSYPYT

SEQ ID NO: 116676 - protein, 9 aa, Homo sapiens
  heavy chain complementarity determining region 3 for antibody 58338
VSYYYGMDV

SEQ ID NO: 116677 - protein, 9 aa, Homo sapiens
  light chain complementarity determining region 3 for antibody 58339
QQYNSYPYT

SEQ ID NO: 116678 - protein, 9 aa, Homo sapiens
  heavy chain complementarity determining region 3 for antibody 58339
VRYYYAMDV

SEQ ID NO: 116679 - protein, 9 aa, Homo sapiens
  light chain complementarity determining region 3 for antibody 58340
QQYNSYPYT

SEQ ID NO: 116680 - protein, 10 aa, Homo sapiens
  heavy chain complementarity determining region 3 for antibody 58340
ASSNCGDFDY

SEQ ID NO: 116681 - protein, 9 aa, Homo sapiens
  light chain complementarity determining region 3 for antibody 58341
QQYNSYPYT

SEQ ID NO: 116682 - protein, 11 aa, Homo sapiens
  heavy chain complementarity determining region 3 for antibody 58341
ASAPWELLLDY

SEQ ID NO: 116683 - protein, 9 aa, Homo sapiens
  light chain complementarity determining region 3 for antibody 58342
QQYNSYPYT

SEQ ID NO: 116684 - protein, 9 aa, Homo sapiens
  heavy chain complementarity determining region 3 for antibody 58342
ARYYHGVDV

SEQ ID NO: 116685 - protein, 9 aa, Homo sapiens
  light chain complementarity determining region 3 for antibody 58343
QQYNSYPYT

SEQ ID NO: 116686 - protein, 12 aa, Homo sapiens
  heavy chain complementarity determining region 3 for antibody 58343
ARVVGVWSPFDY

SEQ ID NO: 116687 - protein, 9 aa, Homo sapiens
  light chain complementarity determining region 3 for antibody 58344
QQYNSYPYT

SEQ ID NO: 116688 - protein, 12 aa, Homo sapiens
  heavy chain complementarity determining region 3 for antibody 58344
ARVVGVSSPFDF

SEQ ID NO: 116689 - protein, 9 aa, Homo sapiens
  light chain complementarity determining region 3 for antibody 58345
QQYNSYPYT

SEQ ID NO: 116690 - protein, 10 aa, Homo sapiens
  heavy chain complementarity determining region 3 for antibody 58345
ARSNWCDFDY

SEQ ID NO: 116691 - protein, 9 aa, Homo sapiens
  light chain complementarity determining region 3 for antibody 58346
QQYNSYPYT

SEQ ID NO: 116692 - protein, 10 aa, Homo sapiens
  heavy chain complementarity determining region 3 for antibody 58346
ARSISGDFAY

SEQ ID NO: 116693 - protein, 9 aa, Homo sapiens
  light chain complementarity determining region 3 for antibody 58347
QQYNSYPYT

SEQ ID NO: 116694 - protein, 10 aa, Homo sapiens
  heavy chain complementarity determining region 3 for antibody 58347
ARSDWGDFDY

SEQ ID NO: 116695 - protein, 9 aa, Homo sapiens
  light chain complementarity determining region 3 for antibody 58348
QQYNSYPYT

SEQ ID NO: 116696 - protein, 10 aa, Homo sapiens
  heavy chain complementarity determining region 3 for antibody 58348
ARGGLGPFDY

SEQ ID NO: 116697 - protein, 9 aa, Homo sapiens
  light chain complementarity determining region 3 for antibody 58349
QQYNSYPYT

SEQ ID NO: 116698 - protein, 11 aa, Homo sapiens
  heavy chain complementarity determining region 3 for antibody 58349
ARGDSSGCFDY

SEQ ID NO: 116699 - protein, 9 aa, Homo sapiens
  light chain complementarity determining region 3 for antibody 58350
QQYNSYPYT

SEQ ID NO: 116700 - protein, 15 aa, Homo sapiens
  heavy chain complementarity determining region 3 for antibody 58350
AREGATRNYSYGMDV

SEQ ID NO: 116701 - protein, 9 aa, Homo sapiens
  light chain complementarity determining region 3 for antibody 58351
QQYNSYPYT

SEQ ID NO: 116702 - protein, 12 aa, Homo sapiens
  heavy chain complementarity determining region 3 for antibody 58351
AREAAAGTWFDP

SEQ ID NO: 116703 - protein, 9 aa, Homo sapiens
  light chain complementarity determining region 3 for antibody 58352
QQYNSYPYT

SEQ ID NO: 116704 - protein, 12 aa, Homo sapiens
  heavy chain complementarity determining region 3 for antibody 58352
AREAAAANWFDP

SEQ ID NO: 116705 - protein, 9 aa, Homo sapiens
  light chain complementarity determining region 3 for antibody 58353
QQYNSYPYT

SEQ ID NO: 116706 - protein, 18 aa, Homo sapiens
  heavy chain complementarity determining region 3 for antibody 58353
ARDGHYYGSGSYEDCFDP

SEQ ID NO: 116707 - protein, 9 aa, Homo sapiens
  light chain complementarity determining region 3 for antibody 58354
QQYNSYPYT

SEQ ID NO: 116708 - protein, 12 aa, Homo sapiens
  heavy chain complementarity determining region 3 for antibody 58354
ARDGGFGEVDDY

SEQ ID NO: 116709 - protein, 9 aa, Homo sapiens
  light chain complementarity determining region 3 for antibody 58355
QQYNSYPYT

SEQ ID NO: 116710 - protein, 16 aa, Homo sapiens
  heavy chain complementarity determining region 3 for antibody 58355
ARDDNWDHYYYYGMDV

SEQ ID NO: 116711 - protein, 9 aa, Homo sapiens
  light chain complementarity determining region 3 for antibody 58356
QQYNSYPRT

SEQ ID NO: 116712 - protein, 21 aa, Homo sapiens
  heavy chain complementarity determining region 3 for antibody 58356
SRETDYDILTGPYYNYYTMDV

SEQ ID NO: 116713 - protein, 9 aa, Homo sapiens
  light chain complementarity determining region 3 for antibody 58357
QQYNSYPRT

SEQ ID NO: 116714 - protein, 21 aa, Homo sapiens
  heavy chain complementarity determining region 3 for antibody 58357
ARETDYEILTGTYYNYYTMDV

SEQ ID NO: 116715 - protein, 9 aa, Homo sapiens
  light chain complementarity determining region 3 for antibody 58358
QQYNSYPRT

SEQ ID NO: 116716 - protein, 21 aa, Homo sapiens
  heavy chain complementarity determining region 3 for antibody 58358
ARETDYEILTGPYSNYYTMDV

SEQ ID NO: 116717 - protein, 9 aa, Homo sapiens
  light chain complementarity determining region 3 for antibody 58359
QQYNSYPRT

SEQ ID NO: 116718 - protein, 21 aa, Homo sapiens
  heavy chain complementarity determining region 3 for antibody 58359
ARETDYDSLTGPYYNYYAMDV

SEQ ID NO: 116719 - protein, 9 aa, Homo sapiens
  light chain complementarity determining region 3 for antibody 58360
QQYNSYPRT

SEQ ID NO: 116720 - protein, 21 aa, Homo sapiens
  heavy chain complementarity determining region 3 for antibody 58360
ARETDYDILTGTYYNYYTMDV

SEQ ID NO: 116721 - protein, 9 aa, Homo sapiens
  light chain complementarity determining region 3 for antibody 58361
QQYNSYPRT

SEQ ID NO: 116722 - protein, 21 aa, Homo sapiens
  heavy chain complementarity determining region 3 for antibody 58361
ARETDYDILTGPDYNYYTMDV

SEQ ID NO: 116723 - protein, 9 aa, Homo sapiens
  light chain complementarity determining region 3 for antibody 58362
QQYNSYPRT

SEQ ID NO: 116724 - protein, 21 aa, Homo sapiens
  heavy chain complementarity determining region 3 for antibody 58362
ARETDDEVLTGPDYNYYTMDV

SEQ ID NO: 116725 - protein, 9 aa, Homo sapiens
  light chain complementarity determining region 3 for antibody 58363
QQYNSYPRT

SEQ ID NO: 116726 - protein, 21 aa, Homo sapiens
  heavy chain complementarity determining region 3 for antibody 58363
ARESEHDILTGPYYNYYDMDV

SEQ ID NO: 116727 - protein, 9 aa, Homo sapiens
  light chain complementarity determining region 3 for antibody 58364
QQYNSYPRT

SEQ ID NO: 116728 - protein, 21 aa, Homo sapiens
  heavy chain complementarity determining region 3 for antibody 58364
ARESDHDILTGTYYNYYDMDV

SEQ ID NO: 116729 - protein, 9 aa, Homo sapiens
  light chain complementarity determining region 3 for antibody 58365
QQYNSYPRT

SEQ ID NO: 116730 - protein, 21 aa, Homo sapiens
  heavy chain complementarity determining region 3 for antibody 58365
ARESDHDILTGHYYNYYDMDV

SEQ ID NO: 116731 - protein, 9 aa, Homo sapiens
  light chain complementarity determining region 3 for antibody 58366
QQYNSYPRT

SEQ ID NO: 116732 - protein, 21 aa, Homo sapiens
  heavy chain complementarity determining region 3 for antibody 58366
ARESDHDILAGPYYNYYDMDV

SEQ ID NO: 116733 - protein, 9 aa, Homo sapiens
  light chain complementarity determining region 3 for antibody 58367
QQYNSYPRT

SEQ ID NO: 116734 - protein, 9 aa, Homo sapiens
  heavy chain complementarity determining region 3 for antibody 58367
ARELSSLDV

SEQ ID NO: 116735 - protein, 9 aa, Homo sapiens
  light chain complementarity determining region 3 for antibody 58368
QQYNSYPRT

SEQ ID NO: 116736 - protein, 15 aa, Homo sapiens
  heavy chain complementarity determining region 3 for antibody 58368
AKAGDYYGSGSPFDY

SEQ ID NO: 116737 - protein, 9 aa, Homo sapiens
  light chain complementarity determining region 3 for antibody 58369
QQYNSYPPT

SEQ ID NO: 116738 - protein, 14 aa, Homo sapiens
  heavy chain complementarity determining region 3 for antibody 58369
ARDPSGSYFNWFDP

SEQ ID NO: 116739 - protein, 9 aa, Homo sapiens
  light chain complementarity determining region 3 for antibody 58370
QQYNSYPPT

SEQ ID NO: 116740 - protein, 14 aa, Homo sapiens
  heavy chain complementarity determining region 3 for antibody 58370
ARDHSGSYFNWFDL

SEQ ID NO: 116741 - protein, 9 aa, Homo sapiens
  light chain complementarity determining region 3 for antibody 58371
QQYNSYPPT

SEQ ID NO: 116742 - protein, 14 aa, Homo sapiens
  heavy chain complementarity determining region 3 for antibody 58371
ARDHSGSYFNWFAP

SEQ ID NO: 116743 - protein, 9 aa, Homo sapiens
  light chain complementarity determining region 3 for antibody 58372
QQYNSYPPT

SEQ ID NO: 116744 - protein, 14 aa, Homo sapiens
  heavy chain complementarity determining region 3 for antibody 58372
ARDHSGSYFNGFDS

SEQ ID NO: 116745 - protein, 9 aa, Homo sapiens
  light chain complementarity determining region 3 for antibody 58373
QQYNSYPPT

SEQ ID NO: 116746 - protein, 14 aa, Homo sapiens
  heavy chain complementarity determining region 3 for antibody 58373
ARDHSGIYFNWFDP

SEQ ID NO: 116747 - protein, 9 aa, Homo sapiens
  light chain complementarity determining region 3 for antibody 58374
QQYNSYPPT

SEQ ID NO: 116748 - protein, 14 aa, Homo sapiens
  heavy chain complementarity determining region 3 for antibody 58374
ARDHSGIYFNWFDH

SEQ ID NO: 116749 - protein, 9 aa, Homo sapiens
  light chain complementarity determining region 3 for antibody 58375
QQYNSYPPT

SEQ ID NO: 116750 - protein, 14 aa, Homo sapiens
  heavy chain complementarity determining region 3 for antibody 58375
ARDHSGIYFNCFDP

SEQ ID NO: 116751 - protein, 9 aa, Homo sapiens
  light chain complementarity determining region 3 for antibody 58376
QQYNSYPPT

SEQ ID NO: 116752 - protein, 14 aa, Homo sapiens
  heavy chain complementarity determining region 3 for antibody 58376
ARDHSGGYYNWFDL

SEQ ID NO: 116753 - protein, 9 aa, Homo sapiens
  light chain complementarity determining region 3 for antibody 58377
QQYNSYPLT

SEQ ID NO: 116754 - protein, 9 aa, Homo sapiens
  heavy chain complementarity determining region 3 for antibody 58377
ATAAADPDY

SEQ ID NO: 116755 - protein, 9 aa, Homo sapiens
  light chain complementarity determining region 3 for antibody 58378
QQYNSYPLT

SEQ ID NO: 116756 - protein, 9 aa, Homo sapiens
  heavy chain complementarity determining region 3 for antibody 58378
ATAAADHDY

SEQ ID NO: 116757 - protein, 9 aa, Homo sapiens
  light chain complementarity determining region 3 for antibody 58379
QQYNSYPLT

SEQ ID NO: 116758 - protein, 9 aa, Homo sapiens
  heavy chain complementarity determining region 3 for antibody 58379
ARGKAATAP

SEQ ID NO: 116759 - protein, 9 aa, Homo sapiens
  light chain complementarity determining region 3 for antibody 58380
QQYNSYPLT

SEQ ID NO: 116760 - protein, 9 aa, Homo sapiens
  heavy chain complementarity determining region 3 for antibody 58380
ARGKAAAGH

SEQ ID NO: 116761 - protein, 9 aa, Homo sapiens
  light chain complementarity determining region 3 for antibody 58381
QQYNSYPLT

SEQ ID NO: 116762 - protein, 9 aa, Homo sapiens
  heavy chain complementarity determining region 3 for antibody 58381
ARGKAAADP

SEQ ID NO: 116763 - protein, 9 aa, Homo sapiens
  light chain complementarity determining region 3 for antibody 58382
QQYNSYPLT

SEQ ID NO: 116764 - protein, 18 aa, Homo sapiens
  heavy chain complementarity determining region 3 for antibody 58382
ANGGYYGSGSYYRDWFDH

SEQ ID NO: 116765 - protein, 9 aa, Homo sapiens
  light chain complementarity determining region 3 for antibody 58383
QQYNSYPLT

SEQ ID NO: 116766 - protein, 9 aa, Homo sapiens
  heavy chain complementarity determining region 3 for antibody 58383
AIAAADPAY

SEQ ID NO: 116767 - protein, 9 aa, Homo sapiens
  light chain complementarity determining region 3 for antibody 58384
QQYNSYPIT

SEQ ID NO: 116768 - protein, 12 aa, Homo sapiens
  heavy chain complementarity determining region 3 for antibody 58384
ASVVRGVRGFDY

SEQ ID NO: 116769 - protein, 9 aa, Homo sapiens
  light chain complementarity determining region 3 for antibody 58385
QQYNSYPIT

SEQ ID NO: 116770 - protein, 12 aa, Homo sapiens
  heavy chain complementarity determining region 3 for antibody 58385
ARVGRGVRGFDY

SEQ ID NO: 116771 - protein, 9 aa, Homo sapiens
  light chain complementarity determining region 3 for antibody 58386
QQYNSYPFT

SEQ ID NO: 116772 - protein, 15 aa, Homo sapiens
  heavy chain complementarity determining region 3 for antibody 58386
AREQGYSGYCGYFDY

SEQ ID NO: 116773 - protein, 9 aa, Homo sapiens
  light chain complementarity determining region 3 for antibody 58387
QQYNSAPWT

SEQ ID NO: 116774 - protein, 15 aa, Homo sapiens
  heavy chain complementarity determining region 3 for antibody 58387
AKAGDYYGSCSPFDY

SEQ ID NO: 116775 - protein, 9 aa, Homo sapiens
  light chain complementarity determining region 3 for antibody 58388
QQYNNWPYT

SEQ ID NO: 116776 - protein, 18 aa, Homo sapiens
  heavy chain complementarity determining region 3 for antibody 58388
AKDRLAYCGGACYSNFDY

SEQ ID NO: 116777 - protein, 9 aa, Homo sapiens
  light chain complementarity determining region 3 for antibody 58389
QQYNNWPRT

SEQ ID NO: 116778 - protein, 11 aa, Homo sapiens
  heavy chain complementarity determining region 3 for antibody 58389
ARLTGYGWFDP

SEQ ID NO: 116779 - protein, 9 aa, Homo sapiens
  light chain complementarity determining region 3 for antibody 58390
QQYNNWPRT

SEQ ID NO: 116780 - protein, 17 aa, Homo sapiens
  heavy chain complementarity determining region 3 for antibody 58390
AKDIVVVTDEVYWYFDL

SEQ ID NO: 116781 - protein, 11 aa, Homo sapiens
  light chain complementarity determining region 3 for antibody 58391
QQYNNWPPMYT

SEQ ID NO: 116782 - protein, 19 aa, Homo sapiens
  heavy chain complementarity determining region 3 for antibody 58391
ARGPLYDSLTGYYYHGLDV

SEQ ID NO: 116783 - protein, 9 aa, Homo sapiens
  light chain complementarity determining region 3 for antibody 58392
QQYNNWPLT

SEQ ID NO: 116784 - protein, 18 aa, Homo sapiens
  heavy chain complementarity determining region 3 for antibody 58392
TRDLRPPGIAVAGGAFDI

SEQ ID NO: 116785 - protein, 9 aa, Homo sapiens
  light chain complementarity determining region 3 for antibody 58393
QQYNNWPLT

SEQ ID NO: 116786 - protein, 18 aa, Homo sapiens
  heavy chain complementarity determining region 3 for antibody 58393
TRDLRPPGIAVAECAFDI

SEQ ID NO: 116787 - protein, 9 aa, Homo sapiens
  light chain complementarity determining region 3 for antibody 58394
QQYNNWPLT

SEQ ID NO: 116788 - protein, 18 aa, Homo sapiens
  heavy chain complementarity determining region 3 for antibody 58394
TRDLRPPGIAAAEGAFDI

SEQ ID NO: 116789 - protein, 9 aa, Homo sapiens
  light chain complementarity determining region 3 for antibody 58395
QQYNNWPLT

SEQ ID NO: 116790 - protein, 18 aa, Homo sapiens
  heavy chain complementarity determining region 3 for antibody 58395
ARDLRPPGIAVAEGAFDI

SEQ ID NO: 116791 - protein, 9 aa, Homo sapiens
  light chain complementarity determining region 3 for antibody 58396
QQYNNWPLT

SEQ ID NO: 116792 - protein, 16 aa, Homo sapiens
  heavy chain complementarity determining region 3 for antibody 58396
ARDGKVLRFFDWYFDL

SEQ ID NO: 116793 - protein, 9 aa, Homo sapiens
  light chain complementarity determining region 3 for antibody 58397
QQYNGYPYT

SEQ ID NO: 116794 - protein, 15 aa, Homo sapiens
  heavy chain complementarity determining region 3 for antibody 58397
AREGATRNYYYGMDV

SEQ ID NO: 116795 - protein, 9 aa, Homo sapiens
  light chain complementarity determining region 3 for antibody 58398
QQYHNWPYT

SEQ ID NO: 116796 - protein, 17 aa, Homo sapiens
  heavy chain complementarity determining region 3 for antibody 58398
ARDLTMVRGVIVYGMDV

SEQ ID NO: 116797 - protein, 9 aa, Homo sapiens
  light chain complementarity determining region 3 for antibody 58399
QQYHNWPYT

SEQ ID NO: 116798 - protein, 17 aa, Homo sapiens
  heavy chain complementarity determining region 3 for antibody 58399
ARDIAMVRGVNHYGMDV

SEQ ID NO: 116799 - protein, 8 aa, Homo sapiens
  light chain complementarity determining region 3 for antibody 58400
QQYGSSYT

SEQ ID NO: 116800 - protein, 20 aa, Homo sapiens
  heavy chain complementarity determining region 3 for antibody 58400
ARDRVLGFGELSPYYYGMDV

SEQ ID NO: 116801 - protein, 9 aa, Homo sapiens
  light chain complementarity determining region 3 for antibody 58401
QQYGSSPYT

SEQ ID NO: 116802 - protein, 17 aa, Homo sapiens
  heavy chain complementarity determining region 3 for antibody 58401
ATDRYVDWLSPLDAFDI

SEQ ID NO: 116803 - protein, 9 aa, Homo sapiens
  light chain complementarity determining region 3 for antibody 58402
QQYGSSPYT

SEQ ID NO: 116804 - protein, 16 aa, Homo sapiens
  heavy chain complementarity determining region 3 for antibody 58402
ARSLLRYFDFTNYFDY

SEQ ID NO: 116805 - protein, 9 aa, Homo sapiens
  light chain complementarity determining region 3 for antibody 58403
QQYGSSPYT

SEQ ID NO: 116806 - protein, 16 aa, Homo sapiens
  heavy chain complementarity determining region 3 for antibody 58403
ARSLLRYFDFRNDFDY

SEQ ID NO: 116807 - protein, 9 aa, Homo sapiens
  light chain complementarity determining region 3 for antibody 58404
QQYGSSPYT

SEQ ID NO: 116808 - protein, 16 aa, Homo sapiens
  heavy chain complementarity determining region 3 for antibody 58404
ARGLLLWFGDPNWFDH

SEQ ID NO: 116809 - protein, 9 aa, Homo sapiens
  light chain complementarity determining region 3 for antibody 58405
QQYGSSPYT

SEQ ID NO: 116810 - protein, 16 aa, Homo sapiens
  heavy chain complementarity determining region 3 for antibody 58405
ARESPYYDIVTGFFDY

SEQ ID NO: 116811 - protein, 9 aa, Homo sapiens
  light chain complementarity determining region 3 for antibody 58406
QQYGSSPYT

SEQ ID NO: 116812 - protein, 16 aa, Homo sapiens
  heavy chain complementarity determining region 3 for antibody 58406
ARESPYYDILTGCFDY

SEQ ID NO: 116813 - protein, 9 aa, Homo sapiens
  light chain complementarity determining region 3 for antibody 58407
QQYGSSPYT

SEQ ID NO: 116814 - protein, 16 aa, Homo sapiens
  heavy chain complementarity determining region 3 for antibody 58407
ARESPYYDILSGFFDY

SEQ ID NO: 116815 - protein, 9 aa, Homo sapiens
  light chain complementarity determining region 3 for antibody 58408
QQYGSSPYT

SEQ ID NO: 116816 - protein, 16 aa, Homo sapiens
  heavy chain complementarity determining region 3 for antibody 58408
AGSLLRYFDFRNYFDY

SEQ ID NO: 116817 - protein, 9 aa, Homo sapiens
  light chain complementarity determining region 3 for antibody 58409
QQYGSSPWT

SEQ ID NO: 116818 - protein, 13 aa, Homo sapiens
  heavy chain complementarity determining region 3 for antibody 58409
AGHVRGVRGVMDV

SEQ ID NO: 116819 - protein, 8 aa, Homo sapiens
  light chain complementarity determining region 3 for antibody 58410
QQYGSSPT

SEQ ID NO: 116820 - protein, 14 aa, Homo sapiens
  heavy chain complementarity determining region 3 for antibody 58410
AGEGYNWGGLYFDY

SEQ ID NO: 116821 - protein, 9 aa, Homo sapiens
  light chain complementarity determining region 3 for antibody 58411
QQYGSSPST

SEQ ID NO: 116822 - protein, 17 aa, Homo sapiens
  heavy chain complementarity determining region 3 for antibody 58411
ATDRYFDWLSPLDAFDI

SEQ ID NO: 116823 - protein, 9 aa, Homo sapiens
  light chain complementarity determining region 3 for antibody 58412
QQYGSSPRT

SEQ ID NO: 116824 - protein, 20 aa, Homo sapiens
  heavy chain complementarity determining region 3 for antibody 58412
ARDMVLWFGELDSYYYGMDV

SEQ ID NO: 116825 - protein, 9 aa, Homo sapiens
  light chain complementarity determining region 3 for antibody 58413
QQYGSSPRT

SEQ ID NO: 116826 - protein, 14 aa, Homo sapiens
  heavy chain complementarity determining region 3 for antibody 58413
AQERLRYFDWFLDY

SEQ ID NO: 116827 - protein, 9 aa, Homo sapiens
  light chain complementarity determining region 3 for antibody 58414
QQYGSSPRT

SEQ ID NO: 116828 - protein, 14 aa, Homo sapiens
  heavy chain complementarity determining region 3 for antibody 58414
AKESLRYFDWFLDY

SEQ ID NO: 116829 - protein, 9 aa, Homo sapiens
  light chain complementarity determining region 3 for antibody 58415
QQYGSSPRT

SEQ ID NO: 116830 - protein, 14 aa, Homo sapiens
  heavy chain complementarity determining region 3 for antibody 58415
AKERSRYFDWFLDY

SEQ ID NO: 116831 - protein, 9 aa, Homo sapiens
  light chain complementarity determining region 3 for antibody 58416
QQYGSSPRT

SEQ ID NO: 116832 - protein, 14 aa, Homo sapiens
  heavy chain complementarity determining region 3 for antibody 58416
AKERLRYFGWFLDY

SEQ ID NO: 116833 - protein, 9 aa, Homo sapiens
  light chain complementarity determining region 3 for antibody 58417
QQYGSSPRT

SEQ ID NO: 116834 - protein, 14 aa, Homo sapiens
  heavy chain complementarity determining region 3 for antibody 58417
AKERLRYFDWVLDY

SEQ ID NO: 116835 - protein, 9 aa, Homo sapiens
  light chain complementarity determining region 3 for antibody 58418
QQYGSSPLT

SEQ ID NO: 116836 - protein, 15 aa, Homo sapiens
  heavy chain complementarity determining region 3 for antibody 58418
ARERYYYGSGAYFDY

SEQ ID NO: 116837 - protein, 9 aa, Homo sapiens
  light chain complementarity determining region 3 for antibody 58419
QQYGSSPLT

SEQ ID NO: 116838 - protein, 13 aa, Homo sapiens
  heavy chain complementarity determining region 3 for antibody 58419
ARDRGSGESHFDH

SEQ ID NO: 116839 - protein, 9 aa, Homo sapiens
  light chain complementarity determining region 3 for antibody 58420
QQYGSSPLT

SEQ ID NO: 116840 - protein, 13 aa, Homo sapiens
  heavy chain complementarity determining region 3 for antibody 58420
AGDRGFGEFHFDH

SEQ ID NO: 116841 - protein, 9 aa, Homo sapiens
  light chain complementarity determining region 3 for antibody 58421
QQYGSSHYT

SEQ ID NO: 116842 - protein, 9 aa, Homo sapiens
  heavy chain complementarity determining region 3 for antibody 58421
AREARGFDY

SEQ ID NO: 116843 - protein, 9 aa, Homo sapiens
  light chain complementarity determining region 3 for antibody 58422
QQYDSYPLT

SEQ ID NO: 116844 - protein, 14 aa, Homo sapiens
  heavy chain complementarity determining region 3 for antibody 58422
ARDRYGGNLNCFDS

SEQ ID NO: 116845 - protein, 9 aa, Homo sapiens
  light chain complementarity determining region 3 for antibody 58423
QQYDNLPYT

SEQ ID NO: 116846 - protein, 16 aa, Homo sapiens
  heavy chain complementarity determining region 3 for antibody 58423
AGGTVDRRSYYYGMDV

SEQ ID NO: 116847 - protein, 9 aa, Homo sapiens
  light chain complementarity determining region 3 for antibody 58424
QQYDNLPYT

SEQ ID NO: 116848 - protein, 16 aa, Homo sapiens
  heavy chain complementarity determining region 3 for antibody 58424
AGGAVARRFYSYGMDV

SEQ ID NO: 116849 - protein, 9 aa, Homo sapiens
  light chain complementarity determining region 3 for antibody 58425
QQYDNLPLT

SEQ ID NO: 116850 - protein, 14 aa, Homo sapiens
  heavy chain complementarity determining region 3 for antibody 58425
ARDRGGSYWGWFDP

SEQ ID NO: 116851 - protein, 9 aa, Homo sapiens
  light chain complementarity determining region 3 for antibody 58426
QQWTSNPLT

SEQ ID NO: 116852 - protein, 14 aa, Homo sapiens
  heavy chain complementarity determining region 3 for antibody 58426
TRSFYYGNYGAMDY

SEQ ID NO: 116853 - protein, 9 aa, Homo sapiens
  light chain complementarity determining region 3 for antibody 58427
QQSYSTPYT

SEQ ID NO: 116854 - protein, 14 aa, Homo sapiens
  heavy chain complementarity determining region 3 for antibody 58427
ARGGYGSGTYLFDY

SEQ ID NO: 116855 - protein, 9 aa, Homo sapiens
  light chain complementarity determining region 3 for antibody 58428
QQSYSTPYT

SEQ ID NO: 116856 - protein, 13 aa, Homo sapiens
  heavy chain complementarity determining region 3 for antibody 58428
ALNYGDYGDWFDP

SEQ ID NO: 116857 - protein, 11 aa, Homo sapiens
  light chain complementarity determining region 3 for antibody 58429
QQSYSTPPEYT

SEQ ID NO: 116858 - protein, 18 aa, Homo sapiens
  heavy chain complementarity determining region 3 for antibody 58429
ARDVLRSFDWLSNNYFDY

SEQ ID NO: 116859 - protein, 9 aa, Homo sapiens
  light chain complementarity determining region 3 for antibody 58430
QQSYSTPLT

SEQ ID NO: 116860 - protein, 15 aa, Homo sapiens
  heavy chain complementarity determining region 3 for antibody 58430
VRRGSLHHYYYGMDV

SEQ ID NO: 116861 - protein, 8 aa, Homo sapiens
  light chain complementarity determining region 3 for antibody 58431
QQSYSTLT

SEQ ID NO: 116862 - protein, 17 aa, Homo sapiens
  heavy chain complementarity determining region 3 for antibody 58431
ARDRDDYGDYSYYGMDV

SEQ ID NO: 116863 - protein, 9 aa, Homo sapiens
  light chain complementarity determining region 3 for antibody 58432
QQSSSLPLT

SEQ ID NO: 116864 - protein, 13 aa, Homo sapiens
  heavy chain complementarity determining region 3 for antibody 58432
ARGGYYGSGSLDY

SEQ ID NO: 116865 - protein, 9 aa, Homo sapiens
  light chain complementarity determining region 3 for antibody 58433
QQSSSLPHT

SEQ ID NO: 116866 - protein, 13 aa, Homo sapiens
  heavy chain complementarity determining region 3 for antibody 58433
ARGGYYGSGSLDY

SEQ ID NO: 116867 - protein, 9 aa, Homo sapiens
  light chain complementarity determining region 3 for antibody 58434
QQSFSTPFT

SEQ ID NO: 116868 - protein, 17 aa, Homo sapiens
  heavy chain complementarity determining region 3 for antibody 58434
ARAESYWDYYYYYGMDA

SEQ ID NO: 116869 - protein, 9 aa, Homo sapiens
  light chain complementarity determining region 3 for antibody 58435
QQSFSTPFT

SEQ ID NO: 116870 - protein, 17 aa, Homo sapiens
  heavy chain complementarity determining region 3 for antibody 58435
ARAESYWDYYYYYGMAV

SEQ ID NO: 116871 - protein, 9 aa, Homo sapiens
  light chain complementarity determining region 3 for antibody 58436
QQSFSTPFT

SEQ ID NO: 116872 - protein, 17 aa, Homo sapiens
  heavy chain complementarity determining region 3 for antibody 58436
ARAESYWDYYYSYGMDV

SEQ ID NO: 116873 - protein, 8 aa, Homo sapiens
  light chain complementarity determining region 3 for antibody 58437
QQRSNWWT

SEQ ID NO: 116874 - protein, 10 aa, Homo sapiens
  heavy chain complementarity determining region 3 for antibody 58437
AREPAYGMDV

SEQ ID NO: 116875 - protein, 9 aa, Homo sapiens
  light chain complementarity determining region 3 for antibody 58438
QQRSNWQLT

SEQ ID NO: 116876 - protein, 12 aa, Homo sapiens
  heavy chain complementarity determining region 3 for antibody 58438
ASRAWGWGYFDY

SEQ ID NO: 116877 - protein, 9 aa, Homo sapiens
  light chain complementarity determining region 3 for antibody 58439
QQRSNWPWT

SEQ ID NO: 116878 - protein, 11 aa, Homo sapiens
  heavy chain complementarity determining region 3 for antibody 58439
ASSTYTSSLDY

SEQ ID NO: 116879 - protein, 9 aa, Homo sapiens
  light chain complementarity determining region 3 for antibody 58440
QQRSNWPWT

SEQ ID NO: 116880 - protein, 7 aa, Homo sapiens
  heavy chain complementarity determining region 3 for antibody 58440
ASDYGDY

SEQ ID NO: 116881 - protein, 9 aa, Homo sapiens
  light chain complementarity determining region 3 for antibody 58441
QQRSNWPPT

SEQ ID NO: 116882 - protein, 13 aa, Homo sapiens
  heavy chain complementarity determining region 3 for antibody 58441
AREGGRAVAGIDY

SEQ ID NO: 116883 - protein, 9 aa, Homo sapiens
  light chain complementarity determining region 3 for antibody 58442
QQRSNWPPT

SEQ ID NO: 116884 - protein, 14 aa, Homo sapiens
  heavy chain complementarity determining region 3 for antibody 58442
ARDYGSGSYAPFDY

SEQ ID NO: 116885 - protein, 9 aa, Homo sapiens
  light chain complementarity determining region 3 for antibody 58443
QQRSNWPPT

SEQ ID NO: 116886 - protein, 14 aa, Homo sapiens
  heavy chain complementarity determining region 3 for antibody 58443
ARDYGAGSYSPFDY

SEQ ID NO: 116887 - protein, 9 aa, Homo sapiens
  light chain complementarity determining region 3 for antibody 58444
QQRSNWPPT

SEQ ID NO: 116888 - protein, 15 aa, Homo sapiens
  heavy chain complementarity determining region 3 for antibody 58444
AKEAFYYGSGSAFDY

SEQ ID NO: 116889 - protein, 9 aa, Homo sapiens
  light chain complementarity determining region 3 for antibody 58445
QQRSKWPPT

SEQ ID NO: 116890 - protein, 14 aa, Homo sapiens
  heavy chain complementarity determining region 3 for antibody 58445
ARDYGSGSYSPFDY

SEQ ID NO: 116891 - protein, 9 aa, Homo sapiens
  light chain complementarity determining region 3 for antibody 58446
QQRGNWPPT

SEQ ID NO: 116892 - protein, 15 aa, Homo sapiens
  heavy chain complementarity determining region 3 for antibody 58446
AKEAYYYGSGSAFDY

SEQ ID NO: 116893 - protein, 9 aa, Homo sapiens
  light chain complementarity determining region 3 for antibody 58447
QQLNTYPYT

SEQ ID NO: 116894 - protein, 11 aa, Homo sapiens
  heavy chain complementarity determining region 3 for antibody 58447
ARIGGNYSIDY

SEQ ID NO: 116895 - protein, 9 aa, Homo sapiens
  light chain complementarity determining region 3 for antibody 58448
QQLNSYPYT

SEQ ID NO: 116896 - protein, 19 aa, Homo sapiens
  heavy chain complementarity determining region 3 for antibody 58448
ARSSYYYDSSGSRSSSFDY

SEQ ID NO: 116897 - protein, 9 aa, Homo sapiens
  light chain complementarity determining region 3 for antibody 58449
QQLNSYPYT

SEQ ID NO: 116898 - protein, 15 aa, Homo sapiens
  heavy chain complementarity determining region 3 for antibody 58449
ARLFRYSGASDAFDI

SEQ ID NO: 116899 - protein, 9 aa, Homo sapiens
  light chain complementarity determining region 3 for antibody 58450
QQLNSYPYT

SEQ ID NO: 116900 - protein, 15 aa, Homo sapiens
  heavy chain complementarity determining region 3 for antibody 58450
ARLFRYSATSDAFDI

SEQ ID NO: 116901 - protein, 9 aa, Homo sapiens
  light chain complementarity determining region 3 for antibody 58451
QQLNSYPYT

SEQ ID NO: 116902 - protein, 15 aa, Homo sapiens
  heavy chain complementarity determining region 3 for antibody 58451
ARHYDILTGYGGFDL

SEQ ID NO: 116903 - protein, 9 aa, Homo sapiens
  light chain complementarity determining region 3 for antibody 58452
QQLNSYPYT

SEQ ID NO: 116904 - protein, 12 aa, Homo sapiens
  heavy chain complementarity determining region 3 for antibody 58452
ARGRGYRYGYDY

SEQ ID NO: 116905 - protein, 9 aa, Homo sapiens
  light chain complementarity determining region 3 for antibody 58453
QQLNSYPYT

SEQ ID NO: 116906 - protein, 12 aa, Homo sapiens
  heavy chain complementarity determining region 3 for antibody 58453
ARGRGSSYGYDY

SEQ ID NO: 116907 - protein, 9 aa, Homo sapiens
  light chain complementarity determining region 3 for antibody 58454
QQLNSYPYT

SEQ ID NO: 116908 - protein, 13 aa, Homo sapiens
  heavy chain complementarity determining region 3 for antibody 58454
AREGDGDQYYFDD

SEQ ID NO: 116909 - protein, 9 aa, Homo sapiens
  light chain complementarity determining region 3 for antibody 58455
QQLNSYPYT

SEQ ID NO: 116910 - protein, 19 aa, Homo sapiens
  heavy chain complementarity determining region 3 for antibody 58455
ARASYYYDSSGYRSSFFDY

SEQ ID NO: 116911 - protein, 9 aa, Homo sapiens
  light chain complementarity determining region 3 for antibody 58456
QQLNSYPWT

SEQ ID NO: 116912 - protein, 17 aa, Homo sapiens
  heavy chain complementarity determining region 3 for antibody 58456
ARVYGSGSYYNYYGMDV

SEQ ID NO: 116913 - protein, 9 aa, Homo sapiens
  light chain complementarity determining region 3 for antibody 58457
QQLNSYPWT

SEQ ID NO: 116914 - protein, 13 aa, Homo sapiens
  heavy chain complementarity determining region 3 for antibody 58457
ARITMVRGVSFAY

SEQ ID NO: 116915 - protein, 9 aa, Homo sapiens
  light chain complementarity determining region 3 for antibody 58458
QQLNSYPWT

SEQ ID NO: 116916 - protein, 13 aa, Homo sapiens
  heavy chain complementarity determining region 3 for antibody 58458
ARITMVRGVSCDY

SEQ ID NO: 116917 - protein, 9 aa, Homo sapiens
  light chain complementarity determining region 3 for antibody 58459
QQLNSYPWT

SEQ ID NO: 116918 - protein, 13 aa, Homo sapiens
  heavy chain complementarity determining region 3 for antibody 58459
ARITMGRGVSFDY

SEQ ID NO: 116919 - protein, 9 aa, Homo sapiens
  light chain complementarity determining region 3 for antibody 58460
QQLNSYPWT

SEQ ID NO: 116920 - protein, 17 aa, Homo sapiens
  heavy chain complementarity determining region 3 for antibody 58460
ARGYGSGSYYSYYGMDV

SEQ ID NO: 116921 - protein, 9 aa, Homo sapiens
  light chain complementarity determining region 3 for antibody 58461
QQLNSYPWT

SEQ ID NO: 116922 - protein, 17 aa, Homo sapiens
  heavy chain complementarity determining region 3 for antibody 58461
ARGYGSGSYYNYSGMDV

SEQ ID NO: 116923 - protein, 9 aa, Homo sapiens
  light chain complementarity determining region 3 for antibody 58462
QQLNSYPWT

SEQ ID NO: 116924 - protein, 17 aa, Homo sapiens
  heavy chain complementarity determining region 3 for antibody 58462
ARGYGSGSYYIYYGMDV

SEQ ID NO: 116925 - protein, 9 aa, Homo sapiens
  light chain complementarity determining region 3 for antibody 58463
QQLNSYPWT

SEQ ID NO: 116926 - protein, 17 aa, Homo sapiens
  heavy chain complementarity determining region 3 for antibody 58463
ARGYGSGSYSNYYGMDV

SEQ ID NO: 116927 - protein, 9 aa, Homo sapiens
  light chain complementarity determining region 3 for antibody 58464
QQLNSYPWT

SEQ ID NO: 116928 - protein, 17 aa, Homo sapiens
  heavy chain complementarity determining region 3 for antibody 58464
ARGYGSGSYDNYYGMDV

SEQ ID NO: 116929 - protein, 9 aa, Homo sapiens
  light chain complementarity determining region 3 for antibody 58465
QQLNSYPWT

SEQ ID NO: 116930 - protein, 17 aa, Homo sapiens
  heavy chain complementarity determining region 3 for antibody 58465
ARGYGSGSDYNYYGMDV

SEQ ID NO: 116931 - protein, 9 aa, Homo sapiens
  light chain complementarity determining region 3 for antibody 58466
QQLNSYPWT

SEQ ID NO: 116932 - protein, 14 aa, Homo sapiens
  heavy chain complementarity determining region 3 for antibody 58466
ARGLLWFGGYVMDV

SEQ ID NO: 116933 - protein, 9 aa, Homo sapiens
  light chain complementarity determining region 3 for antibody 58467
QQLNSYPWT

SEQ ID NO: 116934 - protein, 15 aa, Homo sapiens
  heavy chain complementarity determining region 3 for antibody 58467
ARESREPASYYGMDV

SEQ ID NO: 116935 - protein, 9 aa, Homo sapiens
  light chain complementarity determining region 3 for antibody 58468
QQLNSYPRT

SEQ ID NO: 116936 - protein, 11 aa, Homo sapiens
  heavy chain complementarity determining region 3 for antibody 58468
SRDRRYYGMDV

SEQ ID NO: 116937 - protein, 9 aa, Homo sapiens
  light chain complementarity determining region 3 for antibody 58469
QQLNSYPRT

SEQ ID NO: 116938 - protein, 18 aa, Homo sapiens
  heavy chain complementarity determining region 3 for antibody 58469
ARNYDILTGYYTDEAFDI

SEQ ID NO: 116939 - protein, 9 aa, Homo sapiens
  light chain complementarity determining region 3 for antibody 58470
QQLNSYPRT

SEQ ID NO: 116940 - protein, 18 aa, Homo sapiens
  heavy chain complementarity determining region 3 for antibody 58470
ARNYDILTGYYADDAFDI

SEQ ID NO: 116941 - protein, 9 aa, Homo sapiens
  light chain complementarity determining region 3 for antibody 58471
QQLNSYPRT

SEQ ID NO: 116942 - protein, 11 aa, Homo sapiens
  heavy chain complementarity determining region 3 for antibody 58471
ARGRSYYGMDV

SEQ ID NO: 116943 - protein, 9 aa, Homo sapiens
  light chain complementarity determining region 3 for antibody 58472
QQLNSYPRT

SEQ ID NO: 116944 - protein, 14 aa, Homo sapiens
  heavy chain complementarity determining region 3 for antibody 58472
ARETAAAMPEAFDI

SEQ ID NO: 116945 - protein, 9 aa, Homo sapiens
  light chain complementarity determining region 3 for antibody 58473
QQLNSYPRT

SEQ ID NO: 116946 - protein, 11 aa, Homo sapiens
  heavy chain complementarity determining region 3 for antibody 58473
AREPYSYGMAV

SEQ ID NO: 116947 - protein, 9 aa, Homo sapiens
  light chain complementarity determining region 3 for antibody 58474
QQLNSYPRT

SEQ ID NO: 116948 - protein, 11 aa, Homo sapiens
  heavy chain complementarity determining region 3 for antibody 58474
AREHYYSGMDV

SEQ ID NO: 116949 - protein, 9 aa, Homo sapiens
  light chain complementarity determining region 3 for antibody 58475
QQLNSYPRT

SEQ ID NO: 116950 - protein, 11 aa, Homo sapiens
  heavy chain complementarity determining region 3 for antibody 58475
AREHFYSGMDV

SEQ ID NO: 116951 - protein, 9 aa, Homo sapiens
  light chain complementarity determining region 3 for antibody 58476
QQLNSYPRT

SEQ ID NO: 116952 - protein, 12 aa, Homo sapiens
  heavy chain complementarity determining region 3 for antibody 58476
AREGYSGYDLNC

SEQ ID NO: 116953 - protein, 9 aa, Homo sapiens
  light chain complementarity determining region 3 for antibody 58477
QQLNSYPRT

SEQ ID NO: 116954 - protein, 11 aa, Homo sapiens
  heavy chain complementarity determining region 3 for antibody 58477
ARDRWYYGMDV

SEQ ID NO: 116955 - protein, 9 aa, Homo sapiens
  light chain complementarity determining region 3 for antibody 58478
QQLNSYPRT

SEQ ID NO: 116956 - protein, 11 aa, Homo sapiens
  heavy chain complementarity determining region 3 for antibody 58478
ARDRSYSGMDV

SEQ ID NO: 116957 - protein, 9 aa, Homo sapiens
  light chain complementarity determining region 3 for antibody 58479
QQLNSYPRT

SEQ ID NO: 116958 - protein, 11 aa, Homo sapiens
  heavy chain complementarity determining region 3 for antibody 58479
ARDRSSYGMDV

SEQ ID NO: 116959 - protein, 9 aa, Homo sapiens
  light chain complementarity determining region 3 for antibody 58480
QQLNSYPRT

SEQ ID NO: 116960 - protein, 11 aa, Homo sapiens
  heavy chain complementarity determining region 3 for antibody 58480
ARDRRYYGMDI

SEQ ID NO: 116961 - protein, 9 aa, Homo sapiens
  light chain complementarity determining region 3 for antibody 58481
QQLNSYPRT

SEQ ID NO: 116962 - protein, 11 aa, Homo sapiens
  heavy chain complementarity determining region 3 for antibody 58481
ARDRRSYGMAV

SEQ ID NO: 116963 - protein, 9 aa, Homo sapiens
  light chain complementarity determining region 3 for antibody 58482
QQLNSYPRT

SEQ ID NO: 116964 - protein, 11 aa, Homo sapiens
  heavy chain complementarity determining region 3 for antibody 58482
ARDRRSYAMDV

SEQ ID NO: 116965 - protein, 9 aa, Homo sapiens
  light chain complementarity determining region 3 for antibody 58483
QQLNSYPRT

SEQ ID NO: 116966 - protein, 11 aa, Homo sapiens
  heavy chain complementarity determining region 3 for antibody 58483
ARDRRSSGMDV

SEQ ID NO: 116967 - protein, 9 aa, Homo sapiens
  light chain complementarity determining region 3 for antibody 58484
QQLNSYPRT

SEQ ID NO: 116968 - protein, 11 aa, Homo sapiens
  heavy chain complementarity determining region 3 for antibody 58484
ARDRRDYGMDV

SEQ ID NO: 116969 - protein, 9 aa, Homo sapiens
  light chain complementarity determining region 3 for antibody 58485
QQLNSYPRT

SEQ ID NO: 116970 - protein, 11 aa, Homo sapiens
  heavy chain complementarity determining region 3 for antibody 58485
ARDRMYYGMDA

SEQ ID NO: 116971 - protein, 9 aa, Homo sapiens
  light chain complementarity determining region 3 for antibody 58486
QQLNSYPRT

SEQ ID NO: 116972 - protein, 12 aa, Homo sapiens
  heavy chain complementarity determining region 3 for antibody 58486
ARDPCSSRGFDY

SEQ ID NO: 116973 - protein, 9 aa, Homo sapiens
  light chain complementarity determining region 3 for antibody 58487
QQLNSYPRT

SEQ ID NO: 116974 - protein, 11 aa, Homo sapiens
  heavy chain complementarity determining region 3 for antibody 58487
ARDHYYSGMDV

SEQ ID NO: 116975 - protein, 9 aa, Homo sapiens
  light chain complementarity determining region 3 for antibody 58488
QQLNSYPRT

SEQ ID NO: 116976 - protein, 15 aa, Homo sapiens
  heavy chain complementarity determining region 3 for antibody 58488
AKAGDYYGSGSPFDY

SEQ ID NO: 116977 - protein, 9 aa, Homo sapiens
  light chain complementarity determining region 3 for antibody 58489
QQLNSYPPT

SEQ ID NO: 116978 - protein, 12 aa, Homo sapiens
  heavy chain complementarity determining region 3 for antibody 58489
TFVSGTFNWFDP

SEQ ID NO: 116979 - protein, 9 aa, Homo sapiens
  light chain complementarity determining region 3 for antibody 58490
QQLNSYPPT

SEQ ID NO: 116980 - protein, 12 aa, Homo sapiens
  heavy chain complementarity determining region 3 for antibody 58490
TFFSGPFNWFDP

SEQ ID NO: 116981 - protein, 9 aa, Homo sapiens
  light chain complementarity determining region 3 for antibody 58491
QQLNSYPPT

SEQ ID NO: 116982 - protein, 13 aa, Homo sapiens
  heavy chain complementarity determining region 3 for antibody 58491
ARSFLTRYSPFDY

SEQ ID NO: 116983 - protein, 9 aa, Homo sapiens
  light chain complementarity determining region 3 for antibody 58492
QQLNSYPPT

SEQ ID NO: 116984 - protein, 13 aa, Homo sapiens
  heavy chain complementarity determining region 3 for antibody 58492
ARSFLTIYSPFDY

SEQ ID NO: 116985 - protein, 9 aa, Homo sapiens
  light chain complementarity determining region 3 for antibody 58493
QQLNSYPPT

SEQ ID NO: 116986 - protein, 13 aa, Homo sapiens
  heavy chain complementarity determining region 3 for antibody 58493
ARSFFTSYSPFDY

SEQ ID NO: 116987 - protein, 9 aa, Homo sapiens
  light chain complementarity determining region 3 for antibody 58494
QQLNSYPPT

SEQ ID NO: 116988 - protein, 13 aa, Homo sapiens
  heavy chain complementarity determining region 3 for antibody 58494
ARGGYYGSGSLDY

SEQ ID NO: 116989 - protein, 9 aa, Homo sapiens
  light chain complementarity determining region 3 for antibody 58495
QQLNSYPPT

SEQ ID NO: 116990 - protein, 17 aa, Homo sapiens
  heavy chain complementarity determining region 3 for antibody 58495
ARDPRYYYGAGSSGMDV

SEQ ID NO: 116991 - protein, 9 aa, Homo sapiens
  light chain complementarity determining region 3 for antibody 58496
QQLNSYPPT

SEQ ID NO: 116992 - protein, 17 aa, Homo sapiens
  heavy chain complementarity determining region 3 for antibody 58496
ARDPLYYYGAVSSGMDV

SEQ ID NO: 116993 - protein, 9 aa, Homo sapiens
  light chain complementarity determining region 3 for antibody 58497
QQLNSYPPT

SEQ ID NO: 116994 - protein, 17 aa, Homo sapiens
  heavy chain complementarity determining region 3 for antibody 58497
ARDPLYYYGAGSSGMAV

SEQ ID NO: 116995 - protein, 9 aa, Homo sapiens
  light chain complementarity determining region 3 for antibody 58498
QQLNSYPPT

SEQ ID NO: 116996 - protein, 17 aa, Homo sapiens
  heavy chain complementarity determining region 3 for antibody 58498
ARDPLYYYGAGSSGIDV

SEQ ID NO: 116997 - protein, 9 aa, Homo sapiens
  light chain complementarity determining region 3 for antibody 58499
QQLNSYPPT

SEQ ID NO: 116998 - protein, 17 aa, Homo sapiens
  heavy chain complementarity determining region 3 for antibody 58499
ARDALYYYGAGSSGMDV

SEQ ID NO: 116999 - protein, 9 aa, Homo sapiens
  light chain complementarity determining region 3 for antibody 58500
QQLNSYPPT

SEQ ID NO: 117000 - protein, 13 aa, Homo sapiens
  heavy chain complementarity determining region 3 for antibody 58500
ARAFLTSYSPFDY

SEQ ID NO: 117001 - protein, 9 aa, Homo sapiens
  light chain complementarity determining region 3 for antibody 58501
QQLNSYPPT

SEQ ID NO: 117002 - protein, 11 aa, Homo sapiens
  heavy chain complementarity determining region 3 for antibody 58501
ARAERRGYFDY

SEQ ID NO: 117003 - protein, 9 aa, Homo sapiens
  light chain complementarity determining region 3 for antibody 58502
QQLNSYPPT

SEQ ID NO: 117004 - protein, 11 aa, Homo sapiens
  heavy chain complementarity determining region 3 for antibody 58502
ARAERGGCFDY

SEQ ID NO: 117005 - protein, 9 aa, Homo sapiens
  light chain complementarity determining region 3 for antibody 58503
QQLNSYPPT

SEQ ID NO: 117006 - protein, 11 aa, Homo sapiens
  heavy chain complementarity determining region 3 for antibody 58503
ARAERGEYFDY

SEQ ID NO: 117007 - protein, 9 aa, Homo sapiens
  light chain complementarity determining region 3 for antibody 58504
QQLNSYPPT

SEQ ID NO: 117008 - protein, 11 aa, Homo sapiens
  heavy chain complementarity determining region 3 for antibody 58504
ARAARGGYFDY

SEQ ID NO: 117009 - protein, 9 aa, Homo sapiens
  light chain complementarity determining region 3 for antibody 58505
QQLNSYPPT

SEQ ID NO: 117010 - protein, 15 aa, Homo sapiens
  heavy chain complementarity determining region 3 for antibody 58505
AKAGDYYGSGSPFDY

SEQ ID NO: 117011 - protein, 9 aa, Homo sapiens
  light chain complementarity determining region 3 for antibody 58506
QQLNSYPPM

SEQ ID NO: 117012 - protein, 17 aa, Homo sapiens
  heavy chain complementarity determining region 3 for antibody 58506
ARDPLYYYDAGSSGMDV

SEQ ID NO: 117013 - protein, 9 aa, Homo sapiens
  light chain complementarity determining region 3 for antibody 58507
QQLNSYPLT

SEQ ID NO: 117014 - protein, 12 aa, Homo sapiens
  heavy chain complementarity determining region 3 for antibody 58507
ATMVRGVIPFDY

SEQ ID NO: 117015 - protein, 9 aa, Homo sapiens
  light chain complementarity determining region 3 for antibody 58508
QQLNSYPLT

SEQ ID NO: 117016 - protein, 9 aa, Homo sapiens
  heavy chain complementarity determining region 3 for antibody 58508
ASKKGTFDY

SEQ ID NO: 117017 - protein, 9 aa, Homo sapiens
  light chain complementarity determining region 3 for antibody 58509
QQLNSYPLT

SEQ ID NO: 117018 - protein, 12 aa, Homo sapiens
  heavy chain complementarity determining region 3 for antibody 58509
ARMVWGVIPFDY

SEQ ID NO: 117019 - protein, 9 aa, Homo sapiens
  light chain complementarity determining region 3 for antibody 58510
QQLNSYPLT

SEQ ID NO: 117020 - protein, 12 aa, Homo sapiens
  heavy chain complementarity determining region 3 for antibody 58510
ARMVRGVSAFDY

SEQ ID NO: 117021 - protein, 9 aa, Homo sapiens
  light chain complementarity determining region 3 for antibody 58511
QQLNSYPLT

SEQ ID NO: 117022 - protein, 12 aa, Homo sapiens
  heavy chain complementarity determining region 3 for antibody 58511
ARMVRGVNAFDY

SEQ ID NO: 117023 - protein, 9 aa, Homo sapiens
  light chain complementarity determining region 3 for antibody 58512
QQLNSYPLT

SEQ ID NO: 117024 - protein, 12 aa, Homo sapiens
  heavy chain complementarity determining region 3 for antibody 58512
ARMVRGVITFDY

SEQ ID NO: 117025 - protein, 9 aa, Homo sapiens
  light chain complementarity determining region 3 for antibody 58513
QQLNSYPLT

SEQ ID NO: 117026 - protein, 12 aa, Homo sapiens
  heavy chain complementarity determining region 3 for antibody 58513
ARMVRGVIPLDY

SEQ ID NO: 117027 - protein, 9 aa, Homo sapiens
  light chain complementarity determining region 3 for antibody 58514
QQLNSYPLT

SEQ ID NO: 117028 - protein, 12 aa, Homo sapiens
  heavy chain complementarity determining region 3 for antibody 58514
ARMVRGVIPCDY

SEQ ID NO: 117029 - protein, 9 aa, Homo sapiens
  light chain complementarity determining region 3 for antibody 58515
QQLNSYPLT

SEQ ID NO: 117030 - protein, 12 aa, Homo sapiens
  heavy chain complementarity determining region 3 for antibody 58515
ARLVRGVIPFDY

SEQ ID NO: 117031 - protein, 9 aa, Homo sapiens
  light chain complementarity determining region 3 for antibody 58516
QQLNSYPLT

SEQ ID NO: 117032 - protein, 9 aa, Homo sapiens
  heavy chain complementarity determining region 3 for antibody 58516
ARKNGTFDY

SEQ ID NO: 117033 - protein, 9 aa, Homo sapiens
  light chain complementarity determining region 3 for antibody 58517
QQLNSYPLT

SEQ ID NO: 117034 - protein, 14 aa, Homo sapiens
  heavy chain complementarity determining region 3 for antibody 58517
AREGTSYYSYGMDV

SEQ ID NO: 117035 - protein, 9 aa, Homo sapiens
  light chain complementarity determining region 3 for antibody 58518
QQLNSYPLT

SEQ ID NO: 117036 - protein, 14 aa, Homo sapiens
  heavy chain complementarity determining region 3 for antibody 58518
AREGTAYYYYGMDV

SEQ ID NO: 117037 - protein, 9 aa, Homo sapiens
  light chain complementarity determining region 3 for antibody 58519
QQLNSYPLT

SEQ ID NO: 117038 - protein, 15 aa, Homo sapiens
  heavy chain complementarity determining region 3 for antibody 58519
ARDGGYSGYPFGMDV

SEQ ID NO: 117039 - protein, 9 aa, Homo sapiens
  light chain complementarity determining region 3 for antibody 58520
QQLNSYPLT

SEQ ID NO: 117040 - protein, 15 aa, Homo sapiens
  heavy chain complementarity determining region 3 for antibody 58520
ARDGGYSGFPIGMDV

SEQ ID NO: 117041 - protein, 9 aa, Homo sapiens
  light chain complementarity determining region 3 for antibody 58521
QQLNSYPLT

SEQ ID NO: 117042 - protein, 15 aa, Homo sapiens
  heavy chain complementarity determining region 3 for antibody 58521
ARDGGYSGCPIGMDV

SEQ ID NO: 117043 - protein, 9 aa, Homo sapiens
  light chain complementarity determining region 3 for antibody 58522
QQLNSYPLT

SEQ ID NO: 117044 - protein, 15 aa, Homo sapiens
  heavy chain complementarity determining region 3 for antibody 58522
ARDGGYGGYPIGMDV

SEQ ID NO: 117045 - protein, 9 aa, Homo sapiens
  light chain complementarity determining region 3 for antibody 58523
QQLNSYPLT

SEQ ID NO: 117046 - protein, 15 aa, Homo sapiens
  heavy chain complementarity determining region 3 for antibody 58523
ARDGGYCGYPVGMDV

SEQ ID NO: 117047 - protein, 9 aa, Homo sapiens
  light chain complementarity determining region 3 for antibody 58524
QQLNSYPLT

SEQ ID NO: 117048 - protein, 15 aa, Homo sapiens
  heavy chain complementarity determining region 3 for antibody 58524
ARDGGYCGYPTGMDV

SEQ ID NO: 117049 - protein, 9 aa, Homo sapiens
  light chain complementarity determining region 3 for antibody 58525
QQLNSYPLT

SEQ ID NO: 117050 - protein, 15 aa, Homo sapiens
  heavy chain complementarity determining region 3 for antibody 58525
ARDGGYCGSPTGMDV

SEQ ID NO: 117051 - protein, 9 aa, Homo sapiens
  light chain complementarity determining region 3 for antibody 58526
QQLNSYPLT

SEQ ID NO: 117052 - protein, 15 aa, Homo sapiens
  heavy chain complementarity determining region 3 for antibody 58526
ARDGGYCGSPIGMDV

SEQ ID NO: 117053 - protein, 9 aa, Homo sapiens
  light chain complementarity determining region 3 for antibody 58527
QQLNSYPLT

SEQ ID NO: 117054 - protein, 15 aa, Homo sapiens
  heavy chain complementarity determining region 3 for antibody 58527
ARDGGDSGYPIGMDV

SEQ ID NO: 117055 - protein, 9 aa, Homo sapiens
  light chain complementarity determining region 3 for antibody 58528
QQLNSYPLT

SEQ ID NO: 117056 - protein, 14 aa, Homo sapiens
  heavy chain complementarity determining region 3 for antibody 58528
AGRHYDILTGFSDY

SEQ ID NO: 117057 - protein, 9 aa, Homo sapiens
  light chain complementarity determining region 3 for antibody 58529
QQLNSYPLT

SEQ ID NO: 117058 - protein, 12 aa, Homo sapiens
  heavy chain complementarity determining region 3 for antibody 58529
AGMVRGVIPFDY

SEQ ID NO: 117059 - protein, 9 aa, Homo sapiens
  light chain complementarity determining region 3 for antibody 58530
QQLNSYPLT

SEQ ID NO: 117060 - protein, 15 aa, Homo sapiens
  heavy chain complementarity determining region 3 for antibody 58530
AGDGGYSGYPIGMDV

SEQ ID NO: 117061 - protein, 9 aa, Homo sapiens
  light chain complementarity determining region 3 for antibody 58531
QQLNSYPIT

SEQ ID NO: 117062 - protein, 9 aa, Homo sapiens
  heavy chain complementarity determining region 3 for antibody 58531
ARNRGTFDI

SEQ ID NO: 117063 - protein, 9 aa, Homo sapiens
  light chain complementarity determining region 3 for antibody 58532
QQLNSYPFT

SEQ ID NO: 117064 - protein, 21 aa, Homo sapiens
  heavy chain complementarity determining region 3 for antibody 58532
ARGEDYYGSGTPSYYSYGMDV

SEQ ID NO: 117065 - protein, 9 aa, Homo sapiens
  light chain complementarity determining region 3 for antibody 58533
QQLNSYPFT

SEQ ID NO: 117066 - protein, 21 aa, Homo sapiens
  heavy chain complementarity determining region 3 for antibody 58533
ARGEDYYGAGTPSYYYYGMDV

SEQ ID NO: 117067 - protein, 9 aa, Homo sapiens
  light chain complementarity determining region 3 for antibody 58534
QQLNSYPFT

SEQ ID NO: 117068 - protein, 15 aa, Homo sapiens
  heavy chain complementarity determining region 3 for antibody 58534
ARDYYYGSGSRCFDP

SEQ ID NO: 117069 - protein, 9 aa, Homo sapiens
  light chain complementarity determining region 3 for antibody 58535
QQLNSYPFT

SEQ ID NO: 117070 - protein, 21 aa, Homo sapiens
  heavy chain complementarity determining region 3 for antibody 58535
AGGEDYYGSGTPSYYYYGMDV

SEQ ID NO: 117071 - protein, 9 aa, Homo sapiens
  light chain complementarity determining region 3 for antibody 58536
QQLNSHPRT

SEQ ID NO: 117072 - protein, 11 aa, Homo sapiens
  heavy chain complementarity determining region 3 for antibody 58536
ARDRRYYGMDV

SEQ ID NO: 117073 - protein, 9 aa, Homo sapiens
  light chain complementarity determining region 3 for antibody 58537
QQLKSYPRT

SEQ ID NO: 117074 - protein, 11 aa, Homo sapiens
  heavy chain complementarity determining region 3 for antibody 58537
ARDRSYYGIDV

SEQ ID NO: 117075 - protein, 9 aa, Homo sapiens
  light chain complementarity determining region 3 for antibody 58538
QQLKSYPRT

SEQ ID NO: 117076 - protein, 11 aa, Homo sapiens
  heavy chain complementarity determining region 3 for antibody 58538
ARDRRYYGIDV

SEQ ID NO: 117077 - protein, 9 aa, Homo sapiens
  light chain complementarity determining region 3 for antibody 58539
QQLKSYPRT

SEQ ID NO: 117078 - protein, 11 aa, Homo sapiens
  heavy chain complementarity determining region 3 for antibody 58539
ARDRGYYGMDV

SEQ ID NO: 117079 - protein, 9 aa, Homo sapiens
  light chain complementarity determining region 3 for antibody 58540
QQLKSYPRT

SEQ ID NO: 117080 - protein, 11 aa, Homo sapiens
  heavy chain complementarity determining region 3 for antibody 58540
ARDPRYYGMDV

SEQ ID NO: 117081 - protein, 9 aa, Homo sapiens
  light chain complementarity determining region 3 for antibody 58541
QQINSYPRT

SEQ ID NO: 117082 - protein, 11 aa, Homo sapiens
  heavy chain complementarity determining region 3 for antibody 58541
AREPYYYGMDV

SEQ ID NO: 117083 - protein, 9 aa, Homo sapiens
  light chain complementarity determining region 3 for antibody 58542
QQGQSYPYT

SEQ ID NO: 117084 - protein, 10 aa, Homo sapiens
  heavy chain complementarity determining region 3 for antibody 58542
ARGGNYYFDY

SEQ ID NO: 117085 - protein, 9 aa, Homo sapiens
  light chain complementarity determining region 3 for antibody 58543
QQFYNYPYT

SEQ ID NO: 117086 - protein, 13 aa, Homo sapiens
  heavy chain complementarity determining region 3 for antibody 58543
ARGGYYGSGSLDY

SEQ ID NO: 117087 - protein, 9 aa, Homo sapiens
  light chain complementarity determining region 3 for antibody 58544
QQFYNYPYT

SEQ ID NO: 117088 - protein, 11 aa, Homo sapiens
  heavy chain complementarity determining region 3 for antibody 58544
ARDPRTAGFDN

SEQ ID NO: 117089 - protein, 9 aa, Homo sapiens
  light chain complementarity determining region 3 for antibody 58545
QQFYNYPYT

SEQ ID NO: 117090 - protein, 11 aa, Homo sapiens
  heavy chain complementarity determining region 3 for antibody 58545
ARDPRISGFDY

SEQ ID NO: 117091 - protein, 9 aa, Homo sapiens
  light chain complementarity determining region 3 for antibody 58546
QQFYNYPYT

SEQ ID NO: 117092 - protein, 11 aa, Homo sapiens
  heavy chain complementarity determining region 3 for antibody 58546
ARDPRISGFDS

SEQ ID NO: 117093 - protein, 9 aa, Homo sapiens
  light chain complementarity determining region 3 for antibody 58547
QQFYNYPRT

SEQ ID NO: 117094 - protein, 12 aa, Homo sapiens
  heavy chain complementarity determining region 3 for antibody 58547
GRDWGIGGGMDV

SEQ ID NO: 117095 - protein, 9 aa, Homo sapiens
  light chain complementarity determining region 3 for antibody 58548
QQFYNYPRT

SEQ ID NO: 117096 - protein, 11 aa, Homo sapiens
  heavy chain complementarity determining region 3 for antibody 58548
ARKRVGAHFDY

SEQ ID NO: 117097 - protein, 9 aa, Homo sapiens
  light chain complementarity determining region 3 for antibody 58549
QQFYNYPRT

SEQ ID NO: 117098 - protein, 11 aa, Homo sapiens
  heavy chain complementarity determining region 3 for antibody 58549
ARKIVGARFDY

SEQ ID NO: 117099 - protein, 9 aa, Homo sapiens
  light chain complementarity determining region 3 for antibody 58550
QQFYNYPRT

SEQ ID NO: 117100 - protein, 12 aa, Homo sapiens
  heavy chain complementarity determining region 3 for antibody 58550
ARDWGIGGGMDF

SEQ ID NO: 117101 - protein, 9 aa, Homo sapiens
  light chain complementarity determining region 3 for antibody 58551
QQFYNYPRT

SEQ ID NO: 117102 - protein, 12 aa, Homo sapiens
  heavy chain complementarity determining region 3 for antibody 58551
ARDWGIGGGMDD

SEQ ID NO: 117103 - protein, 9 aa, Homo sapiens
  light chain complementarity determining region 3 for antibody 58552
QQFYNYPRT

SEQ ID NO: 117104 - protein, 12 aa, Homo sapiens
  heavy chain complementarity determining region 3 for antibody 58552
ARDWGIGGGMAV

SEQ ID NO: 117105 - protein, 9 aa, Homo sapiens
  light chain complementarity determining region 3 for antibody 58553
QQFYNYPRT

SEQ ID NO: 117106 - protein, 12 aa, Homo sapiens
  heavy chain complementarity determining region 3 for antibody 58553
ARDWGIGDGMDV

SEQ ID NO: 117107 - protein, 9 aa, Homo sapiens
  light chain complementarity determining region 3 for antibody 58554
QQFYNYPRT

SEQ ID NO: 117108 - protein, 12 aa, Homo sapiens
  heavy chain complementarity determining region 3 for antibody 58554
ARDWGIGCGMDV

SEQ ID NO: 117109 - protein, 9 aa, Homo sapiens
  light chain complementarity determining region 3 for antibody 58555
QQFYNYPHT

SEQ ID NO: 117110 - protein, 13 aa, Homo sapiens
  heavy chain complementarity determining region 3 for antibody 58555
WRFLEGIGGAFDI

SEQ ID NO: 117111 - protein, 9 aa, Homo sapiens
  light chain complementarity determining region 3 for antibody 58556
QQFYNYPHT

SEQ ID NO: 117112 - protein, 13 aa, Homo sapiens
  heavy chain complementarity determining region 3 for antibody 58556
GSFLEGIGGAFDI

SEQ ID NO: 117113 - protein, 9 aa, Homo sapiens
  light chain complementarity determining region 3 for antibody 58557
QQFYNYPHT

SEQ ID NO: 117114 - protein, 13 aa, Homo sapiens
  heavy chain complementarity determining region 3 for antibody 58557
GRVLEGIGGAFDI

SEQ ID NO: 117115 - protein, 9 aa, Homo sapiens
  light chain complementarity determining region 3 for antibody 58558
QQFYNYPHT

SEQ ID NO: 117116 - protein, 13 aa, Homo sapiens
  heavy chain complementarity determining region 3 for antibody 58558
GRLLEGIGGAFDI

SEQ ID NO: 117117 - protein, 9 aa, Homo sapiens
  light chain complementarity determining region 3 for antibody 58559
QQFYNYPHT

SEQ ID NO: 117118 - protein, 13 aa, Homo sapiens
  heavy chain complementarity determining region 3 for antibody 58559
GRFLEWIGGAFDI

SEQ ID NO: 117119 - protein, 9 aa, Homo sapiens
  light chain complementarity determining region 3 for antibody 58560
QQFYNYPHT

SEQ ID NO: 117120 - protein, 13 aa, Homo sapiens
  heavy chain complementarity determining region 3 for antibody 58560
GRFLEGIVGAFDI

SEQ ID NO: 117121 - protein, 9 aa, Homo sapiens
  light chain complementarity determining region 3 for antibody 58561
QQFYNYPHT

SEQ ID NO: 117122 - protein, 13 aa, Homo sapiens
  heavy chain complementarity determining region 3 for antibody 58561
GRFLEGIGGAFDN

SEQ ID NO: 117123 - protein, 9 aa, Homo sapiens
  light chain complementarity determining region 3 for antibody 58562
QQFYNYPHT

SEQ ID NO: 117124 - protein, 13 aa, Homo sapiens
  heavy chain complementarity determining region 3 for antibody 58562
GRFLEGIAGAFDI

SEQ ID NO: 117125 - protein, 9 aa, Homo sapiens
  light chain complementarity determining region 3 for antibody 58563
QQFYNYPHT

SEQ ID NO: 117126 - protein, 13 aa, Homo sapiens
  heavy chain complementarity determining region 3 for antibody 58563
GRCLEGIGGAFDI

SEQ ID NO: 117127 - protein, 9 aa, Homo sapiens
  light chain complementarity determining region 3 for antibody 58564
QQFYNYPHT

SEQ ID NO: 117128 - protein, 13 aa, Homo sapiens
  heavy chain complementarity determining region 3 for antibody 58564
ARSLEGIGGAFDI

SEQ ID NO: 117129 - protein, 8 aa, Homo sapiens
  light chain complementarity determining region 3 for antibody 58565
QQFNTYHT

SEQ ID NO: 117130 - protein, 12 aa, Homo sapiens
  heavy chain complementarity determining region 3 for antibody 58565
ARYYLYSYGMDV

SEQ ID NO: 117131 - protein, 8 aa, Homo sapiens
  light chain complementarity determining region 3 for antibody 58566
QQFNSYPT

SEQ ID NO: 117132 - protein, 13 aa, Homo sapiens
  heavy chain complementarity determining region 3 for antibody 58566
ARDVTGTPSGFDY

SEQ ID NO: 117133 - protein, 9 aa, Homo sapiens
  light chain complementarity determining region 3 for antibody 58567
QQFNNYPYT

SEQ ID NO: 117134 - protein, 12 aa, Homo sapiens
  heavy chain complementarity determining region 3 for antibody 58567
ARVGTFGEFFDY

SEQ ID NO: 117135 - protein, 9 aa, Homo sapiens
  light chain complementarity determining region 3 for antibody 58568
QQFNNYPYT

SEQ ID NO: 117136 - protein, 12 aa, Homo sapiens
  heavy chain complementarity determining region 3 for antibody 58568
ARVGRFGESFDY

SEQ ID NO: 117137 - protein, 9 aa, Homo sapiens
  light chain complementarity determining region 3 for antibody 58569
QQFNNYPYT

SEQ ID NO: 117138 - protein, 12 aa, Homo sapiens
  heavy chain complementarity determining region 3 for antibody 58569
ARVGRFGECFDY

SEQ ID NO: 117139 - protein, 9 aa, Homo sapiens
  light chain complementarity determining region 3 for antibody 58570
QQFNNYPYT

SEQ ID NO: 117140 - protein, 12 aa, Homo sapiens
  heavy chain complementarity determining region 3 for antibody 58570
ARVGRFEEFFDY

SEQ ID NO: 117141 - protein, 9 aa, Homo sapiens
  light chain complementarity determining region 3 for antibody 58571
QQFNNYPYT

SEQ ID NO: 117142 - protein, 14 aa, Homo sapiens
  heavy chain complementarity determining region 3 for antibody 58571
ARRFRIAVAAPFAY

SEQ ID NO: 117143 - protein, 9 aa, Homo sapiens
  light chain complementarity determining region 3 for antibody 58572
QQFNNYPYT

SEQ ID NO: 117144 - protein, 14 aa, Homo sapiens
  heavy chain complementarity determining region 3 for antibody 58572
ARRFRIAVAAAFDY

SEQ ID NO: 117145 - protein, 9 aa, Homo sapiens
  light chain complementarity determining region 3 for antibody 58573
QQFNNYPYT

SEQ ID NO: 117146 - protein, 14 aa, Homo sapiens
  heavy chain complementarity determining region 3 for antibody 58573
ARRCRIAVAAPFDY

SEQ ID NO: 117147 - protein, 9 aa, Homo sapiens
  light chain complementarity determining region 3 for antibody 58574
QQFNNYPYT

SEQ ID NO: 117148 - protein, 14 aa, Homo sapiens
  heavy chain complementarity determining region 3 for antibody 58574
ARGFRIAVAAPFDY

SEQ ID NO: 117149 - protein, 9 aa, Homo sapiens
  light chain complementarity determining region 3 for antibody 58575
QQFNNYPYT

SEQ ID NO: 117150 - protein, 17 aa, Homo sapiens
  heavy chain complementarity determining region 3 for antibody 58575
AREGYYYGSGSYYTFAY

SEQ ID NO: 117151 - protein, 9 aa, Homo sapiens
  light chain complementarity determining region 3 for antibody 58576
QQFNNYPYT

SEQ ID NO: 117152 - protein, 17 aa, Homo sapiens
  heavy chain complementarity determining region 3 for antibody 58576
AREGYYYGLGSYYTFDY

SEQ ID NO: 117153 - protein, 9 aa, Homo sapiens
  light chain complementarity determining region 3 for antibody 58577
QQFNNYPYT

SEQ ID NO: 117154 - protein, 17 aa, Homo sapiens
  heavy chain complementarity determining region 3 for antibody 58577
AREGYYSGSGSYYTFDY

SEQ ID NO: 117155 - protein, 9 aa, Homo sapiens
  light chain complementarity determining region 3 for antibody 58578
QQFNNYPYT

SEQ ID NO: 117156 - protein, 17 aa, Homo sapiens
  heavy chain complementarity determining region 3 for antibody 58578
AREGYSYGSGSYYTFDY

SEQ ID NO: 117157 - protein, 9 aa, Homo sapiens
  light chain complementarity determining region 3 for antibody 58579
QQFNNYPYT

SEQ ID NO: 117158 - protein, 17 aa, Homo sapiens
  heavy chain complementarity determining region 3 for antibody 58579
AREGYSYGSGSYYAFDY

SEQ ID NO: 117159 - protein, 8 aa, Homo sapiens
  light chain complementarity determining region 3 for antibody 58580
QQFNNYPT

SEQ ID NO: 117160 - protein, 13 aa, Homo sapiens
  heavy chain complementarity determining region 3 for antibody 58580
ARDSSSRYEYFDL

SEQ ID NO: 117161 - protein, 8 aa, Homo sapiens
  light chain complementarity determining region 3 for antibody 58581
QQFNNYPT

SEQ ID NO: 117162 - protein, 13 aa, Homo sapiens
  heavy chain complementarity determining region 3 for antibody 58581
ARDSSSLYEYFDL

SEQ ID NO: 117163 - protein, 9 aa, Homo sapiens
  light chain complementarity determining region 3 for antibody 58582
QQFNNYPRT

SEQ ID NO: 117164 - protein, 17 aa, Homo sapiens
  heavy chain complementarity determining region 3 for antibody 58582
AREQIVVVTAINDAFDI

SEQ ID NO: 117165 - protein, 9 aa, Homo sapiens
  light chain complementarity determining region 3 for antibody 58583
QQFNNYPRT

SEQ ID NO: 117166 - protein, 17 aa, Homo sapiens
  heavy chain complementarity determining region 3 for antibody 58583
AREHNVVVTAINDAFDI

SEQ ID NO: 117167 - protein, 9 aa, Homo sapiens
  light chain complementarity determining region 3 for antibody 58584
QQFNNYPRT

SEQ ID NO: 117168 - protein, 17 aa, Homo sapiens
  heavy chain complementarity determining region 3 for antibody 58584
AREHLVVVTAINDAFDI

SEQ ID NO: 117169 - protein, 9 aa, Homo sapiens
  light chain complementarity determining region 3 for antibody 58585
QQFNNYPRT

SEQ ID NO: 117170 - protein, 17 aa, Homo sapiens
  heavy chain complementarity determining region 3 for antibody 58585
AREHIGVVTAINDAFDI

SEQ ID NO: 117171 - protein, 9 aa, Homo sapiens
  light chain complementarity determining region 3 for antibody 58586
QQFNNYPRA

SEQ ID NO: 117172 - protein, 17 aa, Homo sapiens
  heavy chain complementarity determining region 3 for antibody 58586
AREHIVVVTAINDAFDI

SEQ ID NO: 117173 - protein, 9 aa, Homo sapiens
  light chain complementarity determining region 3 for antibody 58587
QQFNNYPLT

SEQ ID NO: 117174 - protein, 22 aa, Homo sapiens
  heavy chain complementarity determining region 3 for antibody 58587
AKQSHDYDSESYRHYYYYGMDV

SEQ ID NO: 117175 - protein, 9 aa, Homo sapiens
  light chain complementarity determining region 3 for antibody 58588
QQFNNYPLT

SEQ ID NO: 117176 - protein, 15 aa, Homo sapiens
  heavy chain complementarity determining region 3 for antibody 58588
AKALYSGSYYNFFDY

SEQ ID NO: 117177 - protein, 9 aa, Homo sapiens
  light chain complementarity determining region 3 for antibody 58589
QQFNNYPHT

SEQ ID NO: 117178 - protein, 17 aa, Homo sapiens
  heavy chain complementarity determining region 3 for antibody 58589
ARYPGIGGYYYYYGMDV

SEQ ID NO: 117179 - protein, 9 aa, Homo sapiens
  light chain complementarity determining region 3 for antibody 58590
QQFNNYPHT

SEQ ID NO: 117180 - protein, 18 aa, Homo sapiens
  heavy chain complementarity determining region 3 for antibody 58590
ARVWFGELPYYSYYGMDV

SEQ ID NO: 117181 - protein, 9 aa, Homo sapiens
  light chain complementarity determining region 3 for antibody 58591
QQFNNYPHT

SEQ ID NO: 117182 - protein, 18 aa, Homo sapiens
  heavy chain complementarity determining region 3 for antibody 58591
ARVWFGELPYYFYYGMDV

SEQ ID NO: 117183 - protein, 9 aa, Homo sapiens
  light chain complementarity determining region 3 for antibody 58592
QQFNNYPHT

SEQ ID NO: 117184 - protein, 18 aa, Homo sapiens
  heavy chain complementarity determining region 3 for antibody 58592
ARVWCGELPYYYYYGMDV

SEQ ID NO: 117185 - protein, 9 aa, Homo sapiens
  light chain complementarity determining region 3 for antibody 58593
QQFNNYIFT

SEQ ID NO: 117186 - protein, 22 aa, Homo sapiens
  heavy chain complementarity determining region 3 for antibody 58593
ARDRHYYGSGGYSYYYYYGMDV

SEQ ID NO: 117187 - protein, 9 aa, Homo sapiens
  light chain complementarity determining region 3 for antibody 58594
QQFNKYPYT

SEQ ID NO: 117188 - protein, 14 aa, Homo sapiens
  heavy chain complementarity determining region 3 for antibody 58594
ARRFRISVAAAFDY

SEQ ID NO: 117189 - protein, 9 aa, Homo sapiens
  light chain complementarity determining region 3 for antibody 58595
QQFNIYPYT

SEQ ID NO: 117190 - protein, 14 aa, Homo sapiens
  heavy chain complementarity determining region 3 for antibody 58595
ARRSRIAVAAPFDY

SEQ ID NO: 117191 - protein, 8 aa, Homo sapiens
  light chain complementarity determining region 3 for antibody 58596
QQFNDYYT

SEQ ID NO: 117192 - protein, 10 aa, Homo sapiens
  heavy chain complementarity determining region 3 for antibody 58596
VRINSGRFDY

SEQ ID NO: 117193 - protein, 8 aa, Homo sapiens
  light chain complementarity determining region 3 for antibody 58597
QQFNDYYT

SEQ ID NO: 117194 - protein, 10 aa, Homo sapiens
  heavy chain complementarity determining region 3 for antibody 58597
ARTNSGRFDY

SEQ ID NO: 117195 - protein, 9 aa, Homo sapiens
  light chain complementarity determining region 3 for antibody 58598
QQFFNYPYT

SEQ ID NO: 117196 - protein, 11 aa, Homo sapiens
  heavy chain complementarity determining region 3 for antibody 58598
ARVPRIAGFDC

SEQ ID NO: 117197 - protein, 9 aa, Homo sapiens
  light chain complementarity determining region 3 for antibody 58599
QQFFNYPYT

SEQ ID NO: 117198 - protein, 11 aa, Homo sapiens
  heavy chain complementarity determining region 3 for antibody 58599
ARGPRIAGFDC

SEQ ID NO: 117199 - protein, 9 aa, Homo sapiens
  light chain complementarity determining region 3 for antibody 58600
QQFFNYPYT

SEQ ID NO: 117200 - protein, 11 aa, Homo sapiens
  heavy chain complementarity determining region 3 for antibody 58600
ARDTRIAGFDC

SEQ ID NO: 117201 - protein, 9 aa, Homo sapiens
  light chain complementarity determining region 3 for antibody 58601
QQFFNYPYT

SEQ ID NO: 117202 - protein, 11 aa, Homo sapiens
  heavy chain complementarity determining region 3 for antibody 58601
ARDPRIAGLDC

SEQ ID NO: 117203 - protein, 9 aa, Homo sapiens
  light chain complementarity determining region 3 for antibody 58602
QQFFNYPYT

SEQ ID NO: 117204 - protein, 11 aa, Homo sapiens
  heavy chain complementarity determining region 3 for antibody 58602
ARDPRIAGIDY

SEQ ID NO: 117205 - protein, 9 aa, Homo sapiens
  light chain complementarity determining region 3 for antibody 58603
QQFFNYPYT

SEQ ID NO: 117206 - protein, 11 aa, Homo sapiens
  heavy chain complementarity determining region 3 for antibody 58603
ARDPRIAGFDF

SEQ ID NO: 117207 - protein, 9 aa, Homo sapiens
  light chain complementarity determining region 3 for antibody 58604
QQFFNYPYT

SEQ ID NO: 117208 - protein, 11 aa, Homo sapiens
  heavy chain complementarity determining region 3 for antibody 58604
ARAPRIAGFDC

SEQ ID NO: 117209 - protein, 8 aa, Homo sapiens
  light chain complementarity determining region 3 for antibody 58605
QQDYYLFT

SEQ ID NO: 117210 - protein, 15 aa, Homo sapiens
  heavy chain complementarity determining region 3 for antibody 58605
AKGTAPTYFYNGMDV

SEQ ID NO: 117211 - protein, 8 aa, Homo sapiens
  light chain complementarity determining region 3 for antibody 58606
QQDYYLFT

SEQ ID NO: 117212 - protein, 15 aa, Homo sapiens
  heavy chain complementarity determining region 3 for antibody 58606
AKGTAPTSFYNGLDV

SEQ ID NO: 117213 - protein, 8 aa, Homo sapiens
  light chain complementarity determining region 3 for antibody 58607
QQDYNLYT

SEQ ID NO: 117214 - protein, 16 aa, Homo sapiens
  heavy chain complementarity determining region 3 for antibody 58607
TTEGYYYGSGSYYRGY

SEQ ID NO: 117215 - protein, 8 aa, Homo sapiens
  light chain complementarity determining region 3 for antibody 58608
QQDYNLYT

SEQ ID NO: 117216 - protein, 13 aa, Homo sapiens
  heavy chain complementarity determining region 3 for antibody 58608
AKEKQLVQGGLDV

SEQ ID NO: 117217 - protein, 9 aa, Homo sapiens
  light chain complementarity determining region 3 for antibody 58609
QQDYNLPYT

SEQ ID NO: 117218 - protein, 13 aa, Homo sapiens
  heavy chain complementarity determining region 3 for antibody 58609
ARGIAAAGTLFDY

SEQ ID NO: 117219 - protein, 9 aa, Homo sapiens
  light chain complementarity determining region 3 for antibody 58610
QQDYNLPFT

SEQ ID NO: 117220 - protein, 19 aa, Homo sapiens
  heavy chain complementarity determining region 3 for antibody 58610
TGGEQQLVLGYSYYFGMDV

SEQ ID NO: 117221 - protein, 9 aa, Homo sapiens
  light chain complementarity determining region 3 for antibody 58611
QQDYNLPFT

SEQ ID NO: 117222 - protein, 11 aa, Homo sapiens
  heavy chain complementarity determining region 3 for antibody 58611
ASRVGATGFDY

SEQ ID NO: 117223 - protein, 8 aa, Homo sapiens
  light chain complementarity determining region 3 for antibody 58612
QQDYNLFT

SEQ ID NO: 117224 - protein, 14 aa, Homo sapiens
  heavy chain complementarity determining region 3 for antibody 58612
AKQGSGKFANGMDV

SEQ ID NO: 117225 - protein, 9 aa, Homo sapiens
  light chain complementarity determining region 3 for antibody 58613
QQCYSTPRT

SEQ ID NO: 117226 - protein, 20 aa, Homo sapiens
  heavy chain complementarity determining region 3 for antibody 58613
ERDAGVWFVDPYYYYNGMDV

SEQ ID NO: 117227 - protein, 9 aa, Homo sapiens
  light chain complementarity determining region 3 for antibody 58614
QQCYSTPRT

SEQ ID NO: 117228 - protein, 20 aa, Homo sapiens
  heavy chain complementarity determining region 3 for antibody 58614
ARDAGVWFVDTYYYYNGMDV

SEQ ID NO: 117229 - protein, 9 aa, Homo sapiens
  light chain complementarity determining region 3 for antibody 58615
QQCYSTPRT

SEQ ID NO: 117230 - protein, 20 aa, Homo sapiens
  heavy chain complementarity determining region 3 for antibody 58615
ARDAGVWFVDPYYYYSGMDV

SEQ ID NO: 117231 - protein, 9 aa, Homo sapiens
  light chain complementarity determining region 3 for antibody 58616
QQCYSTPRT

SEQ ID NO: 117232 - protein, 20 aa, Homo sapiens
  heavy chain complementarity determining region 3 for antibody 58616
ARDAGVWFVDPYYCYNGMDV

SEQ ID NO: 117233 - protein, 9 aa, Homo sapiens
  light chain complementarity determining region 3 for antibody 58617
QQCYSTPRT

SEQ ID NO: 117234 - protein, 20 aa, Homo sapiens
  heavy chain complementarity determining region 3 for antibody 58617
ARDAGVWFVDPSYYYNGMDV

SEQ ID NO: 117235 - protein, 9 aa, Homo sapiens
  light chain complementarity determining region 3 for antibody 58618
QQCYSTPRT

SEQ ID NO: 117236 - protein, 20 aa, Homo sapiens
  heavy chain complementarity determining region 3 for antibody 58618
ARDAGVWFGDPYYYYNGMDV

SEQ ID NO: 117237 - protein, 9 aa, Homo sapiens
  light chain complementarity determining region 3 for antibody 58619
QQCYSTPRT

SEQ ID NO: 117238 - protein, 20 aa, Homo sapiens
  heavy chain complementarity determining region 3 for antibody 58619
ARDAGGWFVDPYYYYNGMDV

SEQ ID NO: 117239 - protein, 9 aa, Homo sapiens
  light chain complementarity determining region 3 for antibody 58620
QQCYSTPRP

SEQ ID NO: 117240 - protein, 20 aa, Homo sapiens
  heavy chain complementarity determining region 3 for antibody 58620
ARDAGVWFVDPYYYYNGMDV

SEQ ID NO: 117241 - protein, 9 aa, Homo sapiens
  light chain complementarity determining region 3 for antibody 58621
QLYNSYSRT

SEQ ID NO: 117242 - protein, 19 aa, Homo sapiens
  heavy chain complementarity determining region 3 for antibody 58621
AREPIATIGTESYYYGMDV

SEQ ID NO: 117243 - protein, 9 aa, Homo sapiens
  light chain complementarity determining region 3 for antibody 58622
QLFYNYPHT

SEQ ID NO: 117244 - protein, 11 aa, Homo sapiens
  heavy chain complementarity determining region 3 for antibody 58622
ARDPRIAGFDC

SEQ ID NO: 117245 - protein, 9 aa, Homo sapiens
  light chain complementarity determining region 3 for antibody 58623
QKYNSPPLT

SEQ ID NO: 117246 - protein, 8 aa, Homo sapiens
  heavy chain complementarity determining region 3 for antibody 58623
TRGANSAY

SEQ ID NO: 117247 - protein, 9 aa, Homo sapiens
  light chain complementarity determining region 3 for antibody 58624
QKYNSASWT

SEQ ID NO: 117248 - protein, 15 aa, Homo sapiens
  heavy chain complementarity determining region 3 for antibody 58624
AKAGDYYGSGSPFDY

SEQ ID NO: 117249 - protein, 9 aa, Homo sapiens
  light chain complementarity determining region 3 for antibody 58625
QKYNSAPWT

SEQ ID NO: 117250 - protein, 15 aa, Homo sapiens
  heavy chain complementarity determining region 3 for antibody 58625
ATAGDYYGSASPFDY

SEQ ID NO: 117251 - protein, 9 aa, Homo sapiens
  light chain complementarity determining region 3 for antibody 58626
QKYNSAPWT

SEQ ID NO: 117252 - protein, 12 aa, Homo sapiens
  heavy chain complementarity determining region 3 for antibody 58626
ARMVRGVIPFDY

SEQ ID NO: 117253 - protein, 9 aa, Homo sapiens
  light chain complementarity determining region 3 for antibody 58627
QKYNSAPWT

SEQ ID NO: 117254 - protein, 10 aa, Homo sapiens
  heavy chain complementarity determining region 3 for antibody 58627
ARDSSGWLDY

SEQ ID NO: 117255 - protein, 9 aa, Homo sapiens
  light chain complementarity determining region 3 for antibody 58628
QKYNSAPWT

SEQ ID NO: 117256 - protein, 11 aa, Homo sapiens
  heavy chain complementarity determining region 3 for antibody 58628
ARDRRYYGMDV

SEQ ID NO: 117257 - protein, 9 aa, Homo sapiens
  light chain complementarity determining region 3 for antibody 58629
QKYNSAPWT

SEQ ID NO: 117258 - protein, 18 aa, Homo sapiens
  heavy chain complementarity determining region 3 for antibody 58629
ARDMIAAAGTDYYYGMDV

SEQ ID NO: 117259 - protein, 9 aa, Homo sapiens
  light chain complementarity determining region 3 for antibody 58630
QKYNSAPWT

SEQ ID NO: 117260 - protein, 15 aa, Homo sapiens
  heavy chain complementarity determining region 3 for antibody 58630
ARAGDYYGSGSPFDD

SEQ ID NO: 117261 - protein, 9 aa, Homo sapiens
  light chain complementarity determining region 3 for antibody 58631
QKYNSAPWT

SEQ ID NO: 117262 - protein, 15 aa, Homo sapiens
  heavy chain complementarity determining region 3 for antibody 58631
ANAGDYYGSGRPFDY

SEQ ID NO: 117263 - protein, 9 aa, Homo sapiens
  light chain complementarity determining region 3 for antibody 58632
QKYNSAPWT

SEQ ID NO: 117264 - protein, 15 aa, Homo sapiens
  heavy chain complementarity determining region 3 for antibody 58632
ANAGDYYGSGCPFDY

SEQ ID NO: 117265 - protein, 9 aa, Homo sapiens
  light chain complementarity determining region 3 for antibody 58633
QKYNSAPWT

SEQ ID NO: 117266 - protein, 15 aa, Homo sapiens
  heavy chain complementarity determining region 3 for antibody 58633
ANAGDCYGSGSPFDY

SEQ ID NO: 117267 - protein, 9 aa, Homo sapiens
  light chain complementarity determining region 3 for antibody 58634
QKYNSAPWT

SEQ ID NO: 117268 - protein, 15 aa, Homo sapiens
  heavy chain complementarity determining region 3 for antibody 58634
AKTGDYYGSGSPFDY

SEQ ID NO: 117269 - protein, 9 aa, Homo sapiens
  light chain complementarity determining region 3 for antibody 58635
QKYNSAPWT

SEQ ID NO: 117270 - protein, 14 aa, Homo sapiens
  heavy chain complementarity determining region 3 for antibody 58635
AKERLRYFDWFLDY

SEQ ID NO: 117271 - protein, 9 aa, Homo sapiens
  light chain complementarity determining region 3 for antibody 58636
QKYNSAPWT

SEQ ID NO: 117272 - protein, 15 aa, Homo sapiens
  heavy chain complementarity determining region 3 for antibody 58636
AKAGYYYGSGRPFDY

SEQ ID NO: 117273 - protein, 9 aa, Homo sapiens
  light chain complementarity determining region 3 for antibody 58637
QKYNSAPWT

SEQ ID NO: 117274 - protein, 15 aa, Homo sapiens
  heavy chain complementarity determining region 3 for antibody 58637
AKAGYFYGSGSPFDY

SEQ ID NO: 117275 - protein, 9 aa, Homo sapiens
  light chain complementarity determining region 3 for antibody 58638
QKYNSAPWT

SEQ ID NO: 117276 - protein, 15 aa, Homo sapiens
  heavy chain complementarity determining region 3 for antibody 58638
AKAGNYYGSGSPFDY

SEQ ID NO: 117277 - protein, 9 aa, Homo sapiens
  light chain complementarity determining region 3 for antibody 58639
QKYNSAPWT

SEQ ID NO: 117278 - protein, 15 aa, Homo sapiens
  heavy chain complementarity determining region 3 for antibody 58639
AKAGEYYGSGSPFAY

SEQ ID NO: 117279 - protein, 9 aa, Homo sapiens
  light chain complementarity determining region 3 for antibody 58640
QKYNSAPWT

SEQ ID NO: 117280 - protein, 15 aa, Homo sapiens
  heavy chain complementarity determining region 3 for antibody 58640
AKAGECYGSGSPFDY

SEQ ID NO: 117281 - protein, 9 aa, Homo sapiens
  light chain complementarity determining region 3 for antibody 58641
QKYNSAPWT

SEQ ID NO: 117282 - protein, 15 aa, Homo sapiens
  heavy chain complementarity determining region 3 for antibody 58641
AKAGDYYGSWCPFDY

SEQ ID NO: 117283 - protein, 9 aa, Homo sapiens
  light chain complementarity determining region 3 for antibody 58642
QKYNSAPWT

SEQ ID NO: 117284 - protein, 15 aa, Homo sapiens
  heavy chain complementarity determining region 3 for antibody 58642
AKAGDYYGSVCPFDY

SEQ ID NO: 117285 - protein, 9 aa, Homo sapiens
  light chain complementarity determining region 3 for antibody 58643
QKYNSAPWT

SEQ ID NO: 117286 - protein, 15 aa, Homo sapiens
  heavy chain complementarity determining region 3 for antibody 58643
AKAGDYYGSGWPFDY

SEQ ID NO: 117287 - protein, 9 aa, Homo sapiens
  light chain complementarity determining region 3 for antibody 58644
QKYNSAPWT

SEQ ID NO: 117288 - protein, 15 aa, Homo sapiens
  heavy chain complementarity determining region 3 for antibody 58644
AKAGDYYGSGTPFDY

SEQ ID NO: 117289 - protein, 9 aa, Homo sapiens
  light chain complementarity determining region 3 for antibody 58645
QKYNSAPWT

SEQ ID NO: 117290 - protein, 15 aa, Homo sapiens
  heavy chain complementarity determining region 3 for antibody 58645
AKAGDYYGSGSPFYY

SEQ ID NO: 117291 - protein, 9 aa, Homo sapiens
  light chain complementarity determining region 3 for antibody 58646
QKYNSAPWT

SEQ ID NO: 117292 - protein, 15 aa, Homo sapiens
  heavy chain complementarity determining region 3 for antibody 58646
AKAGDYYGSGSPFEY

SEQ ID NO: 117293 - protein, 9 aa, Homo sapiens
  light chain complementarity determining region 3 for antibody 58647
QKYNSAPWT

SEQ ID NO: 117294 - protein, 15 aa, Homo sapiens
  heavy chain complementarity determining region 3 for antibody 58647
AKAGDYYGSGSACDY

SEQ ID NO: 117295 - protein, 9 aa, Homo sapiens
  light chain complementarity determining region 3 for antibody 58648
QKYNSAPWT

SEQ ID NO: 117296 - protein, 15 aa, Homo sapiens
  heavy chain complementarity determining region 3 for antibody 58648
AKAGDYYGSGRPFAY

SEQ ID NO: 117297 - protein, 9 aa, Homo sapiens
  light chain complementarity determining region 3 for antibody 58649
QKYNSAPWT

SEQ ID NO: 117298 - protein, 15 aa, Homo sapiens
  heavy chain complementarity determining region 3 for antibody 58649
AKAGDYYGSGRHFDY

SEQ ID NO: 117299 - protein, 9 aa, Homo sapiens
  light chain complementarity determining region 3 for antibody 58650
QKYNSAPWT

SEQ ID NO: 117300 - protein, 15 aa, Homo sapiens
  heavy chain complementarity determining region 3 for antibody 58650
AKAGDYYGSGIPFDY

SEQ ID NO: 117301 - protein, 9 aa, Homo sapiens
  light chain complementarity determining region 3 for antibody 58651
QKYNSAPWT

SEQ ID NO: 117302 - protein, 15 aa, Homo sapiens
  heavy chain complementarity determining region 3 for antibody 58651
AKAGDYYGSATPFDY

SEQ ID NO: 117303 - protein, 9 aa, Homo sapiens
  light chain complementarity determining region 3 for antibody 58652
QKYNSAPWT

SEQ ID NO: 117304 - protein, 15 aa, Homo sapiens
  heavy chain complementarity determining region 3 for antibody 58652
AKAGDYYGSASAFDY

SEQ ID NO: 117305 - protein, 9 aa, Homo sapiens
  light chain complementarity determining region 3 for antibody 58653
QKYNSAPWT

SEQ ID NO: 117306 - protein, 15 aa, Homo sapiens
  heavy chain complementarity determining region 3 for antibody 58653
AKAGDYYGPGSPFDD

SEQ ID NO: 117307 - protein, 9 aa, Homo sapiens
  light chain complementarity determining region 3 for antibody 58654
QKYNSAPWT

SEQ ID NO: 117308 - protein, 15 aa, Homo sapiens
  heavy chain complementarity determining region 3 for antibody 58654
AKAGDYYGAGSPSDY

SEQ ID NO: 117309 - protein, 9 aa, Homo sapiens
  light chain complementarity determining region 3 for antibody 58655
QKYNSAPWT

SEQ ID NO: 117310 - protein, 15 aa, Homo sapiens
  heavy chain complementarity determining region 3 for antibody 58655
AKAGDYYGAGSPLDY

SEQ ID NO: 117311 - protein, 9 aa, Homo sapiens
  light chain complementarity determining region 3 for antibody 58656
QKYNSAPWT

SEQ ID NO: 117312 - protein, 15 aa, Homo sapiens
  heavy chain complementarity determining region 3 for antibody 58656
AKAGDYYGAASPFDY

SEQ ID NO: 117313 - protein, 9 aa, Homo sapiens
  light chain complementarity determining region 3 for antibody 58657
QKYNSAPWT

SEQ ID NO: 117314 - protein, 15 aa, Homo sapiens
  heavy chain complementarity determining region 3 for antibody 58657
AKAGDYYASGSAFDY

SEQ ID NO: 117315 - protein, 9 aa, Homo sapiens
  light chain complementarity determining region 3 for antibody 58658
QKYNSAPWT

SEQ ID NO: 117316 - protein, 15 aa, Homo sapiens
  heavy chain complementarity determining region 3 for antibody 58658
AKAGDYGGSGSPFDY

SEQ ID NO: 117317 - protein, 9 aa, Homo sapiens
  light chain complementarity determining region 3 for antibody 58659
QKYNSAPWT

SEQ ID NO: 117318 - protein, 15 aa, Homo sapiens
  heavy chain complementarity determining region 3 for antibody 58659
AKAGDYDGSGSPSDY

SEQ ID NO: 117319 - protein, 9 aa, Homo sapiens
  light chain complementarity determining region 3 for antibody 58660
QKYNSAPWT

SEQ ID NO: 117320 - protein, 15 aa, Homo sapiens
  heavy chain complementarity determining region 3 for antibody 58660
AKAGDYDGSGSPFDH

SEQ ID NO: 117321 - protein, 9 aa, Homo sapiens
  light chain complementarity determining region 3 for antibody 58661
QKYNSAPWT

SEQ ID NO: 117322 - protein, 15 aa, Homo sapiens
  heavy chain complementarity determining region 3 for antibody 58661
AKAGDVYGSGSPFDY

SEQ ID NO: 117323 - protein, 9 aa, Homo sapiens
  light chain complementarity determining region 3 for antibody 58662
QKYNSAPWT

SEQ ID NO: 117324 - protein, 15 aa, Homo sapiens
  heavy chain complementarity determining region 3 for antibody 58662
AKAGDSYGSGSPLDY

SEQ ID NO: 117325 - protein, 9 aa, Homo sapiens
  light chain complementarity determining region 3 for antibody 58663
QKYNSAPWT

SEQ ID NO: 117326 - protein, 15 aa, Homo sapiens
  heavy chain complementarity determining region 3 for antibody 58663
AKAGDSDGSGSPFDY

SEQ ID NO: 117327 - protein, 9 aa, Homo sapiens
  light chain complementarity determining region 3 for antibody 58664
QKYNSAPWT

SEQ ID NO: 117328 - protein, 15 aa, Homo sapiens
  heavy chain complementarity determining region 3 for antibody 58664
AKAGDNYGSGSPFDY

SEQ ID NO: 117329 - protein, 9 aa, Homo sapiens
  light chain complementarity determining region 3 for antibody 58665
QKYNSAPWT

SEQ ID NO: 117330 - protein, 15 aa, Homo sapiens
  heavy chain complementarity determining region 3 for antibody 58665
AKAGDDYGSGGPFDY

SEQ ID NO: 117331 - protein, 9 aa, Homo sapiens
  light chain complementarity determining region 3 for antibody 58666
QKYNSAPWT

SEQ ID NO: 117332 - protein, 15 aa, Homo sapiens
  heavy chain complementarity determining region 3 for antibody 58666
AKAGDDYGAGSPFDY

SEQ ID NO: 117333 - protein, 9 aa, Homo sapiens
  light chain complementarity determining region 3 for antibody 58667
QKYNSAPWT

SEQ ID NO: 117334 - protein, 15 aa, Homo sapiens
  heavy chain complementarity determining region 3 for antibody 58667
AKAGDDYASGSPFDY

SEQ ID NO: 117335 - protein, 9 aa, Homo sapiens
  light chain complementarity determining region 3 for antibody 58668
QKYNSAPWT

SEQ ID NO: 117336 - protein, 15 aa, Homo sapiens
  heavy chain complementarity determining region 3 for antibody 58668
AKAGDDDGSGSPFDY

SEQ ID NO: 117337 - protein, 9 aa, Homo sapiens
  light chain complementarity determining region 3 for antibody 58669
QKYNSAPWT

SEQ ID NO: 117338 - protein, 15 aa, Homo sapiens
  heavy chain complementarity determining region 3 for antibody 58669
AKAGDCYGSGSPLDY

SEQ ID NO: 117339 - protein, 9 aa, Homo sapiens
  light chain complementarity determining region 3 for antibody 58670
QKYNSAPWT

SEQ ID NO: 117340 - protein, 15 aa, Homo sapiens
  heavy chain complementarity determining region 3 for antibody 58670
AKAGDCYGSGSPIDY

SEQ ID NO: 117341 - protein, 9 aa, Homo sapiens
  light chain complementarity determining region 3 for antibody 58671
QKYNSAPWT

SEQ ID NO: 117342 - protein, 15 aa, Homo sapiens
  heavy chain complementarity determining region 3 for antibody 58671
AKAGDCYGSGRAFDY

SEQ ID NO: 117343 - protein, 9 aa, Homo sapiens
  light chain complementarity determining region 3 for antibody 58672
QKYNSAPWT

SEQ ID NO: 117344 - protein, 15 aa, Homo sapiens
  heavy chain complementarity determining region 3 for antibody 58672
AKAGDCYGSGCPFDY

SEQ ID NO: 117345 - protein, 9 aa, Homo sapiens
  light chain complementarity determining region 3 for antibody 58673
QKYNSAPWT

SEQ ID NO: 117346 - protein, 15 aa, Homo sapiens
  heavy chain complementarity determining region 3 for antibody 58673
AKAGDCYGSESPFDY

SEQ ID NO: 117347 - protein, 9 aa, Homo sapiens
  light chain complementarity determining region 3 for antibody 58674
QKYNSAPWT

SEQ ID NO: 117348 - protein, 15 aa, Homo sapiens
  heavy chain complementarity determining region 3 for antibody 58674
AKAGDCYGSASPFDY

SEQ ID NO: 117349 - protein, 9 aa, Homo sapiens
  light chain complementarity determining region 3 for antibody 58675
QKYNSAPWT

SEQ ID NO: 117350 - protein, 15 aa, Homo sapiens
  heavy chain complementarity determining region 3 for antibody 58675
AKAGAYYGAGSPFDY

SEQ ID NO: 117351 - protein, 9 aa, Homo sapiens
  light chain complementarity determining region 3 for antibody 58676
QKYNSAPWT

SEQ ID NO: 117352 - protein, 15 aa, Homo sapiens
  heavy chain complementarity determining region 3 for antibody 58676
AEGGDYYGSGSPFDY

SEQ ID NO: 117353 - protein, 9 aa, Homo sapiens
  light chain complementarity determining region 3 for antibody 58677
QKYNSAPWT

SEQ ID NO: 117354 - protein, 15 aa, Homo sapiens
  heavy chain complementarity determining region 3 for antibody 58677
AEAGDYYGSGRPFDY

SEQ ID NO: 117355 - protein, 9 aa, Homo sapiens
  light chain complementarity determining region 3 for antibody 58678
QKYNSAPWT

SEQ ID NO: 117356 - protein, 15 aa, Homo sapiens
  heavy chain complementarity determining region 3 for antibody 58678
AEAGDYYGAGSPFDY

SEQ ID NO: 117357 - protein, 9 aa, Homo sapiens
  light chain complementarity determining region 3 for antibody 58679
QKYNSAPWT

SEQ ID NO: 117358 - protein, 15 aa, Homo sapiens
  heavy chain complementarity determining region 3 for antibody 58679
AEAGDFYGSGSPFDY

SEQ ID NO: 117359 - protein, 9 aa, Homo sapiens
  light chain complementarity determining region 3 for antibody 58680
QKYNSAPWS

SEQ ID NO: 117360 - protein, 15 aa, Homo sapiens
  heavy chain complementarity determining region 3 for antibody 58680
AKAGDYYGSGSPFDY

SEQ ID NO: 117361 - protein, 9 aa, Homo sapiens
  light chain complementarity determining region 3 for antibody 58681
QKYNSAPWK

SEQ ID NO: 117362 - protein, 15 aa, Homo sapiens
  heavy chain complementarity determining region 3 for antibody 58681
AKAGDYYGSGSPFDY

SEQ ID NO: 117363 - protein, 9 aa, Homo sapiens
  light chain complementarity determining region 3 for antibody 58682
QKYNSAPRT

SEQ ID NO: 117364 - protein, 15 aa, Homo sapiens
  heavy chain complementarity determining region 3 for antibody 58682
AKAGDCYGSGSPFDY

SEQ ID NO: 117365 - protein, 9 aa, Homo sapiens
  light chain complementarity determining region 3 for antibody 58683
QKYNSAPLT

SEQ ID NO: 117366 - protein, 13 aa, Homo sapiens
  heavy chain complementarity determining region 3 for antibody 58683
ARDRYSGYGAFDY

SEQ ID NO: 117367 - protein, 9 aa, Homo sapiens
  light chain complementarity determining region 3 for antibody 58684
QKNNSAPWT

SEQ ID NO: 117368 - protein, 15 aa, Homo sapiens
  heavy chain complementarity determining region 3 for antibody 58684
AKAGDYYGSGSPFDY

SEQ ID NO: 117369 - protein, 9 aa, Homo sapiens
  light chain complementarity determining region 3 for antibody 58685
QKFNSAPWT

SEQ ID NO: 117370 - protein, 15 aa, Homo sapiens
  heavy chain complementarity determining region 3 for antibody 58685
AKAGDYYGSGSPFDY

SEQ ID NO: 117371 - protein, 9 aa, Homo sapiens
  light chain complementarity determining region 3 for antibody 58686
MQSLQTPYT

SEQ ID NO: 117372 - protein, 14 aa, Homo sapiens
  heavy chain complementarity determining region 3 for antibody 58686
ARASGSYYYYGMDV

SEQ ID NO: 117373 - protein, 9 aa, Homo sapiens
  light chain complementarity determining region 3 for antibody 58687
MQALQTPLT

SEQ ID NO: 117374 - protein, 20 aa, Homo sapiens
  heavy chain complementarity determining region 3 for antibody 58687
ARVPLLGFGESFLDYYGMDV

SEQ ID NO: 117375 - protein, 9 aa, Homo sapiens
  light chain complementarity determining region 3 for antibody 58688
MQALQTPLT

SEQ ID NO: 117376 - protein, 20 aa, Homo sapiens
  heavy chain complementarity determining region 3 for antibody 58688
ARVPFLWFGESFLDYYGMDV

SEQ ID NO: 117377 - protein, 9 aa, Homo sapiens
  light chain complementarity determining region 3 for antibody 58689
LQSSSLPHT

SEQ ID NO: 117378 - protein, 13 aa, Homo sapiens
  heavy chain complementarity determining region 3 for antibody 58689
ARGGYYGSGSLDY

SEQ ID NO: 117379 - protein, 9 aa, Homo sapiens
  light chain complementarity determining region 3 for antibody 58690
LQNYNYPYT

SEQ ID NO: 117380 - protein, 13 aa, Homo sapiens
  heavy chain complementarity determining region 3 for antibody 58690
ARDLAVAGYPLDF

SEQ ID NO: 117381 - protein, 9 aa, Homo sapiens
  light chain complementarity determining region 3 for antibody 58691
LQNYNYPYT

SEQ ID NO: 117382 - protein, 13 aa, Homo sapiens
  heavy chain complementarity determining region 3 for antibody 58691
ARDLAVAGYPFDL

SEQ ID NO: 117383 - protein, 9 aa, Homo sapiens
  light chain complementarity determining region 3 for antibody 58692
LQNYNYPYT

SEQ ID NO: 117384 - protein, 13 aa, Homo sapiens
  heavy chain complementarity determining region 3 for antibody 58692
ARDLAAAGYPFDY

SEQ ID NO: 117385 - protein, 9 aa, Homo sapiens
  light chain complementarity determining region 3 for antibody 58693
LQNYNYPYT

SEQ ID NO: 117386 - protein, 13 aa, Homo sapiens
  heavy chain complementarity determining region 3 for antibody 58693
ARDLAAAGYPFDF

SEQ ID NO: 117387 - protein, 9 aa, Homo sapiens
  light chain complementarity determining region 3 for antibody 58694
LQHYSYPYT

SEQ ID NO: 117388 - protein, 18 aa, Homo sapiens
  heavy chain complementarity determining region 3 for antibody 58694
ARESSGGGGYSYYYGMDV

SEQ ID NO: 117389 - protein, 9 aa, Homo sapiens
  light chain complementarity determining region 3 for antibody 58695
LQHNSYPYT

SEQ ID NO: 117390 - protein, 15 aa, Homo sapiens
  heavy chain complementarity determining region 3 for antibody 58695
ATLPYYDILTGYSDY

SEQ ID NO: 117391 - protein, 9 aa, Homo sapiens
  light chain complementarity determining region 3 for antibody 58696
LQHNSYPYT

SEQ ID NO: 117392 - protein, 12 aa, Homo sapiens
  heavy chain complementarity determining region 3 for antibody 58696
ATDRSYYYGMDV

SEQ ID NO: 117393 - protein, 9 aa, Homo sapiens
  light chain complementarity determining region 3 for antibody 58697
LQHNSYPYT

SEQ ID NO: 117394 - protein, 12 aa, Homo sapiens
  heavy chain complementarity determining region 3 for antibody 58697
ATDRSYSYGMDV

SEQ ID NO: 117395 - protein, 9 aa, Homo sapiens
  light chain complementarity determining region 3 for antibody 58698
LQHNSYPYT

SEQ ID NO: 117396 - protein, 14 aa, Homo sapiens
  heavy chain complementarity determining region 3 for antibody 58698
ARGLRYFAWLSQDY

SEQ ID NO: 117397 - protein, 9 aa, Homo sapiens
  light chain complementarity determining region 3 for antibody 58699
LQHNSYPYT

SEQ ID NO: 117398 - protein, 22 aa, Homo sapiens
  heavy chain complementarity determining region 3 for antibody 58699
AREGDMLTGYYNVRYYYYGMDV

SEQ ID NO: 117399 - protein, 9 aa, Homo sapiens
  light chain complementarity determining region 3 for antibody 58700
LQHNSYPYT

SEQ ID NO: 117400 - protein, 13 aa, Homo sapiens
  heavy chain complementarity determining region 3 for antibody 58700
ARDRLTGDPFFDY

SEQ ID NO: 117401 - protein, 9 aa, Homo sapiens
  light chain complementarity determining region 3 for antibody 58701
LQHNSYPYT

SEQ ID NO: 117402 - protein, 13 aa, Homo sapiens
  heavy chain complementarity determining region 3 for antibody 58701
ARDRLTGDLFIDY

SEQ ID NO: 117403 - protein, 9 aa, Homo sapiens
  light chain complementarity determining region 3 for antibody 58702
LQHNSYPYT

SEQ ID NO: 117404 - protein, 13 aa, Homo sapiens
  heavy chain complementarity determining region 3 for antibody 58702
ARDQDYGSGSPDY

SEQ ID NO: 117405 - protein, 9 aa, Homo sapiens
  light chain complementarity determining region 3 for antibody 58703
LQHNSYPYT

SEQ ID NO: 117406 - protein, 12 aa, Homo sapiens
  heavy chain complementarity determining region 3 for antibody 58703
AQDRSYYYGMDV

SEQ ID NO: 117407 - protein, 9 aa, Homo sapiens
  light chain complementarity determining region 3 for antibody 58704
LQHNSYPYT

SEQ ID NO: 117408 - protein, 12 aa, Homo sapiens
  heavy chain complementarity determining region 3 for antibody 58704
AKYRSYYYGMDV

SEQ ID NO: 117409 - protein, 9 aa, Homo sapiens
  light chain complementarity determining region 3 for antibody 58705
LQHNSYPYT

SEQ ID NO: 117410 - protein, 12 aa, Homo sapiens
  heavy chain complementarity determining region 3 for antibody 58705
AKDRSYYYGMDF

SEQ ID NO: 117411 - protein, 9 aa, Homo sapiens
  light chain complementarity determining region 3 for antibody 58706
LQHNSYPYT

SEQ ID NO: 117412 - protein, 12 aa, Homo sapiens
  heavy chain complementarity determining region 3 for antibody 58706
AKDRSYYYGMDA

SEQ ID NO: 117413 - protein, 9 aa, Homo sapiens
  light chain complementarity determining region 3 for antibody 58707
LQHNSYPYT

SEQ ID NO: 117414 - protein, 12 aa, Homo sapiens
  heavy chain complementarity determining region 3 for antibody 58707
AKDRSYYYGIDD

SEQ ID NO: 117415 - protein, 9 aa, Homo sapiens
  light chain complementarity determining region 3 for antibody 58708
LQHNSYPYT

SEQ ID NO: 117416 - protein, 12 aa, Homo sapiens
  heavy chain complementarity determining region 3 for antibody 58708
AKDRSYYYCMDV

SEQ ID NO: 117417 - protein, 9 aa, Homo sapiens
  light chain complementarity determining region 3 for antibody 58709
LQHNSYPYT

SEQ ID NO: 117418 - protein, 12 aa, Homo sapiens
  heavy chain complementarity determining region 3 for antibody 58709
AKDRSYYHGMDV

SEQ ID NO: 117419 - protein, 9 aa, Homo sapiens
  light chain complementarity determining region 3 for antibody 58710
LQHNSYPYT

SEQ ID NO: 117420 - protein, 12 aa, Homo sapiens
  heavy chain complementarity determining region 3 for antibody 58710
AKDKSYYYGMDV

SEQ ID NO: 117421 - protein, 9 aa, Homo sapiens
  light chain complementarity determining region 3 for antibody 58711
LQHNSYPYT

SEQ ID NO: 117422 - protein, 12 aa, Homo sapiens
  heavy chain complementarity determining region 3 for antibody 58711
AKDGSYYYGMDV

SEQ ID NO: 117423 - protein, 9 aa, Homo sapiens
  light chain complementarity determining region 3 for antibody 58712
LQHNSYPYT

SEQ ID NO: 117424 - protein, 16 aa, Homo sapiens
  heavy chain complementarity determining region 3 for antibody 58712
AKDGSGSYYLSEYFHH

SEQ ID NO: 117425 - protein, 9 aa, Homo sapiens
  light chain complementarity determining region 3 for antibody 58713
LQHNSYPYT

SEQ ID NO: 117426 - protein, 16 aa, Homo sapiens
  heavy chain complementarity determining region 3 for antibody 58713
AKDGSGSYYLPEYFQH

SEQ ID NO: 117427 - protein, 9 aa, Homo sapiens
  light chain complementarity determining region 3 for antibody 58714
LQHNSYPYT

SEQ ID NO: 117428 - protein, 22 aa, Homo sapiens
  heavy chain complementarity determining region 3 for antibody 58714
AKDGMPKILTGYYHHYNYGMDV

SEQ ID NO: 117429 - protein, 9 aa, Homo sapiens
  light chain complementarity determining region 3 for antibody 58715
LQHNSYPYT

SEQ ID NO: 117430 - protein, 22 aa, Homo sapiens
  heavy chain complementarity determining region 3 for antibody 58715
AKDGIPKSLTGYYHHYNYGMDV

SEQ ID NO: 117431 - protein, 9 aa, Homo sapiens
  light chain complementarity determining region 3 for antibody 58716
LQHNSYPYT

SEQ ID NO: 117432 - protein, 22 aa, Homo sapiens
  heavy chain complementarity determining region 3 for antibody 58716
AKDGIPKMLTGYYHHYNYGMDV

SEQ ID NO: 117433 - protein, 9 aa, Homo sapiens
  light chain complementarity determining region 3 for antibody 58717
LQHNSYPYT

SEQ ID NO: 117434 - protein, 22 aa, Homo sapiens
  heavy chain complementarity determining region 3 for antibody 58717
AKDGIPKILTGYYHPYNYGMDV

SEQ ID NO: 117435 - protein, 9 aa, Homo sapiens
  light chain complementarity determining region 3 for antibody 58718
LQHNSYPYT

SEQ ID NO: 117436 - protein, 22 aa, Homo sapiens
  heavy chain complementarity determining region 3 for antibody 58718
AKDGIPKILTGYYHHYNSGMDV

SEQ ID NO: 117437 - protein, 9 aa, Homo sapiens
  light chain complementarity determining region 3 for antibody 58719
LQHNSYPYT

SEQ ID NO: 117438 - protein, 16 aa, Homo sapiens
  heavy chain complementarity determining region 3 for antibody 58719
AKDGAGRYYLTEYFQH

SEQ ID NO: 117439 - protein, 9 aa, Homo sapiens
  light chain complementarity determining region 3 for antibody 58720
LQHNSYPYT

SEQ ID NO: 117440 - protein, 12 aa, Homo sapiens
  heavy chain complementarity determining region 3 for antibody 58720
AKARSYYYGMDV

SEQ ID NO: 117441 - protein, 9 aa, Homo sapiens
  light chain complementarity determining region 3 for antibody 58721
LQHNSYPYT

SEQ ID NO: 117442 - protein, 14 aa, Homo sapiens
  heavy chain complementarity determining region 3 for antibody 58721
AGGPYYYGSGPYYK

SEQ ID NO: 117443 - protein, 9 aa, Homo sapiens
  light chain complementarity determining region 3 for antibody 58722
LQHNSYPYT

SEQ ID NO: 117444 - protein, 16 aa, Homo sapiens
  heavy chain complementarity determining region 3 for antibody 58722
AEDGSGSYYLTEYFHH

SEQ ID NO: 117445 - protein, 9 aa, Homo sapiens
  light chain complementarity determining region 3 for antibody 58723
LQHNSYPWT

SEQ ID NO: 117446 - protein, 23 aa, Homo sapiens
  heavy chain complementarity determining region 3 for antibody 58723
ATGDDYVWGSYRYTTYYYYGMDV

SEQ ID NO: 117447 - protein, 9 aa, Homo sapiens
  light chain complementarity determining region 3 for antibody 58724
LQHNSYPWT

SEQ ID NO: 117448 - protein, 20 aa, Homo sapiens
  heavy chain complementarity determining region 3 for antibody 58724
ATDAMVRGVIIEDYSYGMDV

SEQ ID NO: 117449 - protein, 9 aa, Homo sapiens
  light chain complementarity determining region 3 for antibody 58725
LQHNSYPWT

SEQ ID NO: 117450 - protein, 22 aa, Homo sapiens
  heavy chain complementarity determining region 3 for antibody 58725
ARDFPLYYDIWTGYPYYHGMDV

SEQ ID NO: 117451 - protein, 9 aa, Homo sapiens
  light chain complementarity determining region 3 for antibody 58726
LQHNSYPWT

SEQ ID NO: 117452 - protein, 22 aa, Homo sapiens
  heavy chain complementarity determining region 3 for antibody 58726
ARDFPLYYDILTGYPYCHGMDV

SEQ ID NO: 117453 - protein, 9 aa, Homo sapiens
  light chain complementarity determining region 3 for antibody 58727
LQHNSYPWT

SEQ ID NO: 117454 - protein, 22 aa, Homo sapiens
  heavy chain complementarity determining region 3 for antibody 58727
ARDFPLDYDILTGYPYYHGMDV

SEQ ID NO: 117455 - protein, 9 aa, Homo sapiens
  light chain complementarity determining region 3 for antibody 58728
LQHNSYPWT

SEQ ID NO: 117456 - protein, 17 aa, Homo sapiens
  heavy chain complementarity determining region 3 for antibody 58728
ARDDYGDYGYYSYGMDV

SEQ ID NO: 117457 - protein, 9 aa, Homo sapiens
  light chain complementarity determining region 3 for antibody 58729
LQHNSYPWT

SEQ ID NO: 117458 - protein, 17 aa, Homo sapiens
  heavy chain complementarity determining region 3 for antibody 58729
ARDDYGDYGSYYYGMDV

SEQ ID NO: 117459 - protein, 9 aa, Homo sapiens
  light chain complementarity determining region 3 for antibody 58730
LQHNSYPWT

SEQ ID NO: 117460 - protein, 20 aa, Homo sapiens
  heavy chain complementarity determining region 3 for antibody 58730
AADTMVRGVIIEDYYYGMDV

SEQ ID NO: 117461 - protein, 9 aa, Homo sapiens
  light chain complementarity determining region 3 for antibody 58731
LQHNSYPRT

SEQ ID NO: 117462 - protein, 18 aa, Homo sapiens
  heavy chain complementarity determining region 3 for antibody 58731
ATPMTGTTGYYYYYGMDV

SEQ ID NO: 117463 - protein, 9 aa, Homo sapiens
  light chain complementarity determining region 3 for antibody 58732
LQHNSYPRT

SEQ ID NO: 117464 - protein, 18 aa, Homo sapiens
  heavy chain complementarity determining region 3 for antibody 58732
ATPITGTTGYSYYYGMDV

SEQ ID NO: 117465 - protein, 9 aa, Homo sapiens
  light chain complementarity determining region 3 for antibody 58733
LQHNSYPRT

SEQ ID NO: 117466 - protein, 18 aa, Homo sapiens
  heavy chain complementarity determining region 3 for antibody 58733
ATPITGATGYYYYYGMDD

SEQ ID NO: 117467 - protein, 9 aa, Homo sapiens
  light chain complementarity determining region 3 for antibody 58734
LQHNSYPRT

SEQ ID NO: 117468 - protein, 18 aa, Homo sapiens
  heavy chain complementarity determining region 3 for antibody 58734
ATPITGATGYSYYYGMDV

SEQ ID NO: 117469 - protein, 9 aa, Homo sapiens
  light chain complementarity determining region 3 for antibody 58735
LQHNSYPRT

SEQ ID NO: 117470 - protein, 18 aa, Homo sapiens
  heavy chain complementarity determining region 3 for antibody 58735
ATAITGTTGYYYYYGMDV

SEQ ID NO: 117471 - protein, 9 aa, Homo sapiens
  light chain complementarity determining region 3 for antibody 58736
LQHNSYPRT

SEQ ID NO: 117472 - protein, 13 aa, Homo sapiens
  heavy chain complementarity determining region 3 for antibody 58736
AREYCSSTSGYDH

SEQ ID NO: 117473 - protein, 9 aa, Homo sapiens
  light chain complementarity determining region 3 for antibody 58737
LQHNSYPRT

SEQ ID NO: 117474 - protein, 13 aa, Homo sapiens
  heavy chain complementarity determining region 3 for antibody 58737
AREYCSSTSCYEH

SEQ ID NO: 117475 - protein, 9 aa, Homo sapiens
  light chain complementarity determining region 3 for antibody 58738
LQHNSYPRT

SEQ ID NO: 117476 - protein, 13 aa, Homo sapiens
  heavy chain complementarity determining region 3 for antibody 58738
AREYCSSTSCYDY

SEQ ID NO: 117477 - protein, 9 aa, Homo sapiens
  light chain complementarity determining region 3 for antibody 58739
LQHNSYPRT

SEQ ID NO: 117478 - protein, 13 aa, Homo sapiens
  heavy chain complementarity determining region 3 for antibody 58739
AREYCSSTSCYDD

SEQ ID NO: 117479 - protein, 9 aa, Homo sapiens
  light chain complementarity determining region 3 for antibody 58740
LQHNSYPRT

SEQ ID NO: 117480 - protein, 13 aa, Homo sapiens
  heavy chain complementarity determining region 3 for antibody 58740
AREYCSSTSCYAH

SEQ ID NO: 117481 - protein, 9 aa, Homo sapiens
  light chain complementarity determining region 3 for antibody 58741
LQHNSYPRT

SEQ ID NO: 117482 - protein, 13 aa, Homo sapiens
  heavy chain complementarity determining region 3 for antibody 58741
AREYCSRTSCYDH

SEQ ID NO: 117483 - protein, 9 aa, Homo sapiens
  light chain complementarity determining region 3 for antibody 58742
LQHNSYPRT

SEQ ID NO: 117484 - protein, 13 aa, Homo sapiens
  heavy chain complementarity determining region 3 for antibody 58742
AREYCSITSCYDH

SEQ ID NO: 117485 - protein, 9 aa, Homo sapiens
  light chain complementarity determining region 3 for antibody 58743
LQHNSYPRT

SEQ ID NO: 117486 - protein, 18 aa, Homo sapiens
  heavy chain complementarity determining region 3 for antibody 58743
AAPMAGATGYYYYYGMDV

SEQ ID NO: 117487 - protein, 9 aa, Homo sapiens
  light chain complementarity determining region 3 for antibody 58744
LQHNSYPRT

SEQ ID NO: 117488 - protein, 18 aa, Homo sapiens
  heavy chain complementarity determining region 3 for antibody 58744
AAPLTGTTGYYYYYGMDV

SEQ ID NO: 117489 - protein, 9 aa, Homo sapiens
  light chain complementarity determining region 3 for antibody 58745
LQHNSYPRT

SEQ ID NO: 117490 - protein, 18 aa, Homo sapiens
  heavy chain complementarity determining region 3 for antibody 58745
AAPITGATGYYYYYGMDV

SEQ ID NO: 117491 - protein, 9 aa, Homo sapiens
  light chain complementarity determining region 3 for antibody 58746
LQHNSYPRT

SEQ ID NO: 117492 - protein, 18 aa, Homo sapiens
  heavy chain complementarity determining region 3 for antibody 58746
AAPIAGTTGYYYYYGMDV

SEQ ID NO: 117493 - protein, 9 aa, Homo sapiens
  light chain complementarity determining region 3 for antibody 58747
LQHNSYPLT

SEQ ID NO: 117494 - protein, 12 aa, Homo sapiens
  heavy chain complementarity determining region 3 for antibody 58747
ARVGPLSGAFDY

SEQ ID NO: 117495 - protein, 9 aa, Homo sapiens
  light chain complementarity determining region 3 for antibody 58748
LQHNSYPLT

SEQ ID NO: 117496 - protein, 10 aa, Homo sapiens
  heavy chain complementarity determining region 3 for antibody 58748
ARDSSGWLDY

SEQ ID NO: 117497 - protein, 9 aa, Homo sapiens
  light chain complementarity determining region 3 for antibody 58749
LQHNSYPLT

SEQ ID NO: 117498 - protein, 10 aa, Homo sapiens
  heavy chain complementarity determining region 3 for antibody 58749
AKEGSRSRDY

SEQ ID NO: 117499 - protein, 9 aa, Homo sapiens
  light chain complementarity determining region 3 for antibody 58750
LQHNSYPFT

SEQ ID NO: 117500 - protein, 10 aa, Homo sapiens
  heavy chain complementarity determining region 3 for antibody 58750
ERDSSGWLDY

SEQ ID NO: 117501 - protein, 9 aa, Homo sapiens
  light chain complementarity determining region 3 for antibody 58751
LQHNSYPFT

SEQ ID NO: 117502 - protein, 10 aa, Homo sapiens
  heavy chain complementarity determining region 3 for antibody 58751
ASDSTGWLDY

SEQ ID NO: 117503 - protein, 9 aa, Homo sapiens
  light chain complementarity determining region 3 for antibody 58752
LQHNSYPFT

SEQ ID NO: 117504 - protein, 10 aa, Homo sapiens
  heavy chain complementarity determining region 3 for antibody 58752
ASDSSGGLDY

SEQ ID NO: 117505 - protein, 9 aa, Homo sapiens
  light chain complementarity determining region 3 for antibody 58753
LQHNSYPFT

SEQ ID NO: 117506 - protein, 10 aa, Homo sapiens
  heavy chain complementarity determining region 3 for antibody 58753
ARGLAYGMDV

SEQ ID NO: 117507 - protein, 9 aa, Homo sapiens
  light chain complementarity determining region 3 for antibody 58754
LQHNSYPFT

SEQ ID NO: 117508 - protein, 10 aa, Homo sapiens
  heavy chain complementarity determining region 3 for antibody 58754
ARDSSGWLEY

SEQ ID NO: 117509 - protein, 9 aa, Homo sapiens
  light chain complementarity determining region 3 for antibody 58755
LQHNSYPFT

SEQ ID NO: 117510 - protein, 10 aa, Homo sapiens
  heavy chain complementarity determining region 3 for antibody 58755
ARDSSGWLAS

SEQ ID NO: 117511 - protein, 9 aa, Homo sapiens
  light chain complementarity determining region 3 for antibody 58756
LQHNSYPFT

SEQ ID NO: 117512 - protein, 10 aa, Homo sapiens
  heavy chain complementarity determining region 3 for antibody 58756
ARDSSACLDY

SEQ ID NO: 117513 - protein, 9 aa, Homo sapiens
  light chain complementarity determining region 3 for antibody 58757
LQHNSYPFT

SEQ ID NO: 117514 - protein, 10 aa, Homo sapiens
  heavy chain complementarity determining region 3 for antibody 58757
ARDSRGCLDY

SEQ ID NO: 117515 - protein, 9 aa, Homo sapiens
  light chain complementarity determining region 3 for antibody 58758
LQHNSYPFT

SEQ ID NO: 117516 - protein, 18 aa, Homo sapiens
  heavy chain complementarity determining region 3 for antibody 58758
ARDPSGYDAYYYYYGMDV

SEQ ID NO: 117517 - protein, 9 aa, Homo sapiens
  light chain complementarity determining region 3 for antibody 58759
LQHNSYPFT

SEQ ID NO: 117518 - protein, 18 aa, Homo sapiens
  heavy chain complementarity determining region 3 for antibody 58759
AGDPSGYDSYYYYYGMDV

SEQ ID NO: 117519 - protein, 9 aa, Homo sapiens
  light chain complementarity determining region 3 for antibody 58760
LQHNSYLYT

SEQ ID NO: 117520 - protein, 12 aa, Homo sapiens
  heavy chain complementarity determining region 3 for antibody 58760
AKDRSYYYGMDV

SEQ ID NO: 117521 - protein, 9 aa, Homo sapiens
  light chain complementarity determining region 3 for antibody 58761
LQHDNFPYT

SEQ ID NO: 117522 - protein, 18 aa, Homo sapiens
  heavy chain complementarity determining region 3 for antibody 58761
AREGGITMVRGILRGMDV

SEQ ID NO: 117523 - protein, 9 aa, Homo sapiens
  light chain complementarity determining region 3 for antibody 58762
LQHDNFPYT

SEQ ID NO: 117524 - protein, 21 aa, Homo sapiens
  heavy chain complementarity determining region 3 for antibody 58762
AREGAYDSLTGYSDYYYGMDV

SEQ ID NO: 117525 - protein, 9 aa, Homo sapiens
  light chain complementarity determining region 3 for antibody 58763
LQHDNFPYT

SEQ ID NO: 117526 - protein, 21 aa, Homo sapiens
  heavy chain complementarity determining region 3 for antibody 58763
AREGAYDILTGYSDSYYGMDV

SEQ ID NO: 117527 - protein, 9 aa, Homo sapiens
  light chain complementarity determining region 3 for antibody 58764
LQHDNFPYT

SEQ ID NO: 117528 - protein, 13 aa, Homo sapiens
  heavy chain complementarity determining region 3 for antibody 58764
ARDQDYGSGSHDY

SEQ ID NO: 117529 - protein, 9 aa, Homo sapiens
  light chain complementarity determining region 3 for antibody 58765
LQHDNFPYT

SEQ ID NO: 117530 - protein, 18 aa, Homo sapiens
  heavy chain complementarity determining region 3 for antibody 58765
ARDGGVTMVRGILRGMDV

SEQ ID NO: 117531 - protein, 9 aa, Homo sapiens
  light chain complementarity determining region 3 for antibody 58766
LQHDNFPYT

SEQ ID NO: 117532 - protein, 18 aa, Homo sapiens
  heavy chain complementarity determining region 3 for antibody 58766
ARDGGITMVRGMLRGMDV

SEQ ID NO: 117533 - protein, 9 aa, Homo sapiens
  light chain complementarity determining region 3 for antibody 58767
LQHDNFPYT

SEQ ID NO: 117534 - protein, 18 aa, Homo sapiens
  heavy chain complementarity determining region 3 for antibody 58767
ARDGGITIVRGILRGMDV

SEQ ID NO: 117535 - protein, 9 aa, Homo sapiens
  light chain complementarity determining region 3 for antibody 58768
LQHDNFPYT

SEQ ID NO: 117536 - protein, 18 aa, Homo sapiens
  heavy chain complementarity determining region 3 for antibody 58768
ARDGDITMVRGILRGMDV

SEQ ID NO: 117537 - protein, 9 aa, Homo sapiens
  light chain complementarity determining region 3 for antibody 58769
LQHDNFPYT

SEQ ID NO: 117538 - protein, 11 aa, Homo sapiens
  heavy chain complementarity determining region 3 for antibody 58769
ARATNWGDFDY

SEQ ID NO: 117539 - protein, 9 aa, Homo sapiens
  light chain complementarity determining region 3 for antibody 58770
LQHDNFPYT

SEQ ID NO: 117540 - protein, 11 aa, Homo sapiens
  heavy chain complementarity determining region 3 for antibody 58770
ARAPNWGAFDY

SEQ ID NO: 117541 - protein, 9 aa, Homo sapiens
  light chain complementarity determining region 3 for antibody 58771
LQHDNFPYT

SEQ ID NO: 117542 - protein, 11 aa, Homo sapiens
  heavy chain complementarity determining region 3 for antibody 58771
ARAANWGDFDY

SEQ ID NO: 117543 - protein, 9 aa, Homo sapiens
  light chain complementarity determining region 3 for antibody 58772
LQDYTYPYT

SEQ ID NO: 117544 - protein, 16 aa, Homo sapiens
  heavy chain complementarity determining region 3 for antibody 58772
VGGYYGSGTSSRWFDP

SEQ ID NO: 117545 - protein, 9 aa, Homo sapiens
  light chain complementarity determining region 3 for antibody 58773
LQDYTYPWT

SEQ ID NO: 117546 - protein, 10 aa, Homo sapiens
  heavy chain complementarity determining region 3 for antibody 58773
ATMTNVTFDY

SEQ ID NO: 117547 - protein, 9 aa, Homo sapiens
  light chain complementarity determining region 3 for antibody 58774
LQDYSYPWT

SEQ ID NO: 117548 - protein, 10 aa, Homo sapiens
  heavy chain complementarity determining region 3 for antibody 58774
ATRTNVTFDY

SEQ ID NO: 117549 - protein, 9 aa, Homo sapiens
  light chain complementarity determining region 3 for antibody 58775
LQDYSYPWT

SEQ ID NO: 117550 - protein, 10 aa, Homo sapiens
  heavy chain complementarity determining region 3 for antibody 58775
ATMTNVTFAY

SEQ ID NO: 117551 - protein, 9 aa, Homo sapiens
  light chain complementarity determining region 3 for antibody 58776
LQDYSYPWT

SEQ ID NO: 117552 - protein, 10 aa, Homo sapiens
  heavy chain complementarity determining region 3 for antibody 58776
ATMTNVSFDY

SEQ ID NO: 117553 - protein, 9 aa, Homo sapiens
  light chain complementarity determining region 3 for antibody 58777
LQDYSYPWT

SEQ ID NO: 117554 - protein, 10 aa, Homo sapiens
  heavy chain complementarity determining region 3 for antibody 58777
ATMTNGTFDY

SEQ ID NO: 117555 - protein, 9 aa, Homo sapiens
  light chain complementarity determining region 3 for antibody 58778
LQDYSYPWT

SEQ ID NO: 117556 - protein, 14 aa, Homo sapiens
  heavy chain complementarity determining region 3 for antibody 58778
ARGLLWFGGYGLDV

SEQ ID NO: 117557 - protein, 9 aa, Homo sapiens
  light chain complementarity determining region 3 for antibody 58779
LQDYSYPWK

SEQ ID NO: 117558 - protein, 10 aa, Homo sapiens
  heavy chain complementarity determining region 3 for antibody 58779
ATMTNVTFDY

SEQ ID NO: 117559 - protein, 9 aa, Homo sapiens
  light chain complementarity determining region 3 for antibody 58780
LQDYSYPRT

SEQ ID NO: 117560 - protein, 12 aa, Homo sapiens
  heavy chain complementarity determining region 3 for antibody 58780
ARDSCGLNWFDP

SEQ ID NO: 117561 - protein, 9 aa, Homo sapiens
  light chain complementarity determining region 3 for antibody 58781
LQDYNYPYT

SEQ ID NO: 117562 - protein, 22 aa, Homo sapiens
  heavy chain complementarity determining region 3 for antibody 58781
ASEAPLSRLGALSYGGYYGMDV

SEQ ID NO: 117563 - protein, 9 aa, Homo sapiens
  light chain complementarity determining region 3 for antibody 58782
LQDYNYPYT

SEQ ID NO: 117564 - protein, 15 aa, Homo sapiens
  heavy chain complementarity determining region 3 for antibody 58782
ARNAPVIAAAGTIDY

SEQ ID NO: 117565 - protein, 9 aa, Homo sapiens
  light chain complementarity determining region 3 for antibody 58783
LQDYNYPYT

SEQ ID NO: 117566 - protein, 12 aa, Homo sapiens
  heavy chain complementarity determining region 3 for antibody 58783
ARMVREFSPFDY

SEQ ID NO: 117567 - protein, 9 aa, Homo sapiens
  light chain complementarity determining region 3 for antibody 58784
LQDYNYPYT

SEQ ID NO: 117568 - protein, 16 aa, Homo sapiens
  heavy chain complementarity determining region 3 for antibody 58784
ARGYCGSGSSSRWFDP

SEQ ID NO: 117569 - protein, 9 aa, Homo sapiens
  light chain complementarity determining region 3 for antibody 58785
LQDYNYPYT

SEQ ID NO: 117570 - protein, 16 aa, Homo sapiens
  heavy chain complementarity determining region 3 for antibody 58785
ARGYCGSGSSSRWFDH

SEQ ID NO: 117571 - protein, 9 aa, Homo sapiens
  light chain complementarity determining region 3 for antibody 58786
LQDYNYPYT

SEQ ID NO: 117572 - protein, 16 aa, Homo sapiens
  heavy chain complementarity determining region 3 for antibody 58786
ARGSFGSGSSSRWFDH

SEQ ID NO: 117573 - protein, 9 aa, Homo sapiens
  light chain complementarity determining region 3 for antibody 58787
LQDYNYPYT

SEQ ID NO: 117574 - protein, 18 aa, Homo sapiens
  heavy chain complementarity determining region 3 for antibody 58787
ARGAWYYYGSASYYAFDY

SEQ ID NO: 117575 - protein, 9 aa, Homo sapiens
  light chain complementarity determining region 3 for antibody 58788
LQDYNYPYT

SEQ ID NO: 117576 - protein, 18 aa, Homo sapiens
  heavy chain complementarity determining region 3 for antibody 58788
ARGAWYYYGAGSYYTFDY

SEQ ID NO: 117577 - protein, 9 aa, Homo sapiens
  light chain complementarity determining region 3 for antibody 58789
LQDYNYPYT

SEQ ID NO: 117578 - protein, 18 aa, Homo sapiens
  heavy chain complementarity determining region 3 for antibody 58789
ARGAWYSYGSGSYYTFDY

SEQ ID NO: 117579 - protein, 9 aa, Homo sapiens
  light chain complementarity determining region 3 for antibody 58790
LQDYNYPYT

SEQ ID NO: 117580 - protein, 18 aa, Homo sapiens
  heavy chain complementarity determining region 3 for antibody 58790
ARGAGYYYGSGSYYTFDY

SEQ ID NO: 117581 - protein, 9 aa, Homo sapiens
  light chain complementarity determining region 3 for antibody 58791
LQDYNYPYT

SEQ ID NO: 117582 - protein, 17 aa, Homo sapiens
  heavy chain complementarity determining region 3 for antibody 58791
ARFDYYGSGSYGGSFDY

SEQ ID NO: 117583 - protein, 9 aa, Homo sapiens
  light chain complementarity determining region 3 for antibody 58792
LQDYNYPYT

SEQ ID NO: 117584 - protein, 13 aa, Homo sapiens
  heavy chain complementarity determining region 3 for antibody 58792
AREWNLRGNYFDY

SEQ ID NO: 117585 - protein, 9 aa, Homo sapiens
  light chain complementarity determining region 3 for antibody 58793
LQDYNYPYT

SEQ ID NO: 117586 - protein, 13 aa, Homo sapiens
  heavy chain complementarity determining region 3 for antibody 58793
AREWKLRGNSFDY

SEQ ID NO: 117587 - protein, 9 aa, Homo sapiens
  light chain complementarity determining region 3 for antibody 58794
LQDYNYPYT

SEQ ID NO: 117588 - protein, 12 aa, Homo sapiens
  heavy chain complementarity determining region 3 for antibody 58794
AREVGSWRVFDY

SEQ ID NO: 117589 - protein, 9 aa, Homo sapiens
  light chain complementarity determining region 3 for antibody 58795
LQDYNYPYT

SEQ ID NO: 117590 - protein, 12 aa, Homo sapiens
  heavy chain complementarity determining region 3 for antibody 58795
AREGVRGAPFDY

SEQ ID NO: 117591 - protein, 9 aa, Homo sapiens
  light chain complementarity determining region 3 for antibody 58796
LQDYNYPYT

SEQ ID NO: 117592 - protein, 22 aa, Homo sapiens
  heavy chain complementarity determining region 3 for antibody 58796
ARDVRDYEILTGYYNGGNYFDY

SEQ ID NO: 117593 - protein, 9 aa, Homo sapiens
  light chain complementarity determining region 3 for antibody 58797
LQDYNYPYT

SEQ ID NO: 117594 - protein, 22 aa, Homo sapiens
  heavy chain complementarity determining region 3 for antibody 58797
ARDVRDYEDLTGYYNGGNYFDY

SEQ ID NO: 117595 - protein, 9 aa, Homo sapiens
  light chain complementarity determining region 3 for antibody 58798
LQDYNYPYT

SEQ ID NO: 117596 - protein, 22 aa, Homo sapiens
  heavy chain complementarity determining region 3 for antibody 58798
ARDVRDYDSLTGYYNGGNYFDY

SEQ ID NO: 117597 - protein, 9 aa, Homo sapiens
  light chain complementarity determining region 3 for antibody 58799
LQDYNYPYT

SEQ ID NO: 117598 - protein, 22 aa, Homo sapiens
  heavy chain complementarity determining region 3 for antibody 58799
ARDVRDYDDLTGYYTGGNYFDY

SEQ ID NO: 117599 - protein, 9 aa, Homo sapiens
  light chain complementarity determining region 3 for antibody 58800
LQDYNYPYT

SEQ ID NO: 117600 - protein, 22 aa, Homo sapiens
  heavy chain complementarity determining region 3 for antibody 58800
ARDVRDYDDLTGYYNGANYFDY

SEQ ID NO: 117601 - protein, 9 aa, Homo sapiens
  light chain complementarity determining region 3 for antibody 58801
LQDYNYPYT

SEQ ID NO: 117602 - protein, 14 aa, Homo sapiens
  heavy chain complementarity determining region 3 for antibody 58801
ARDRIQLWFPSFDY

SEQ ID NO: 117603 - protein, 9 aa, Homo sapiens
  light chain complementarity determining region 3 for antibody 58802
LQDYNYPYT

SEQ ID NO: 117604 - protein, 15 aa, Homo sapiens
  heavy chain complementarity determining region 3 for antibody 58802
AKEGNLRYFDWLGDY

SEQ ID NO: 117605 - protein, 9 aa, Homo sapiens
  light chain complementarity determining region 3 for antibody 58803
LQDYNYPYT

SEQ ID NO: 117606 - protein, 15 aa, Homo sapiens
  heavy chain complementarity determining region 3 for antibody 58803
AKEGKLRYFDWVRDY

SEQ ID NO: 117607 - protein, 9 aa, Homo sapiens
  light chain complementarity determining region 3 for antibody 58804
LQDYNYPYT

SEQ ID NO: 117608 - protein, 15 aa, Homo sapiens
  heavy chain complementarity determining region 3 for antibody 58804
AKEGKLRYFDWVGDY

SEQ ID NO: 117609 - protein, 9 aa, Homo sapiens
  light chain complementarity determining region 3 for antibody 58805
LQDYNYPYT

SEQ ID NO: 117610 - protein, 15 aa, Homo sapiens
  heavy chain complementarity determining region 3 for antibody 58805
AKEGKLRYFDWSGDY

SEQ ID NO: 117611 - protein, 9 aa, Homo sapiens
  light chain complementarity determining region 3 for antibody 58806
LQDYNYPYT

SEQ ID NO: 117612 - protein, 15 aa, Homo sapiens
  heavy chain complementarity determining region 3 for antibody 58806
AKEGKLRYFDWLWDY

SEQ ID NO: 117613 - protein, 9 aa, Homo sapiens
  light chain complementarity determining region 3 for antibody 58807
LQDYNYPYT

SEQ ID NO: 117614 - protein, 15 aa, Homo sapiens
  heavy chain complementarity determining region 3 for antibody 58807
AKDRYYYGSWSPMDV

SEQ ID NO: 117615 - protein, 9 aa, Homo sapiens
  light chain complementarity determining region 3 for antibody 58808
LQDYNYPYT

SEQ ID NO: 117616 - protein, 15 aa, Homo sapiens
  heavy chain complementarity determining region 3 for antibody 58808
AKDRYYDGSGSPMDV

SEQ ID NO: 117617 - protein, 9 aa, Homo sapiens
  light chain complementarity determining region 3 for antibody 58809
LQDYNYPYT

SEQ ID NO: 117618 - protein, 15 aa, Homo sapiens
  heavy chain complementarity determining region 3 for antibody 58809
AKDGYYYGSGSPMDV

SEQ ID NO: 117619 - protein, 9 aa, Homo sapiens
  light chain complementarity determining region 3 for antibody 58810
LQDYNYPYT

SEQ ID NO: 117620 - protein, 16 aa, Homo sapiens
  heavy chain complementarity determining region 3 for antibody 58810
AGGSFGSGSSSRWFDP

SEQ ID NO: 117621 - protein, 9 aa, Homo sapiens
  light chain complementarity determining region 3 for antibody 58811
LQDYNYPYT

SEQ ID NO: 117622 - protein, 18 aa, Homo sapiens
  heavy chain complementarity determining region 3 for antibody 58811
AGERGLLWFGELRSGMDV

SEQ ID NO: 117623 - protein, 9 aa, Homo sapiens
  light chain complementarity determining region 3 for antibody 58812
LQDYNYPYT

SEQ ID NO: 117624 - protein, 16 aa, Homo sapiens
  heavy chain complementarity determining region 3 for antibody 58812
AEVGGTGGYYYNGLDV

SEQ ID NO: 117625 - protein, 9 aa, Homo sapiens
  light chain complementarity determining region 3 for antibody 58813
LQDYNYPYS

SEQ ID NO: 117626 - protein, 22 aa, Homo sapiens
  heavy chain complementarity determining region 3 for antibody 58813
AREAPLVRLGELSYGGYYGMDV

SEQ ID NO: 117627 - protein, 9 aa, Homo sapiens
  light chain complementarity determining region 3 for antibody 58814
LQDYNYPYS

SEQ ID NO: 117628 - protein, 22 aa, Homo sapiens
  heavy chain complementarity determining region 3 for antibody 58814
AREAALLRLGELSYGGYYGMDV

SEQ ID NO: 117629 - protein, 9 aa, Homo sapiens
  light chain complementarity determining region 3 for antibody 58815
LQDYNYPWT

SEQ ID NO: 117630 - protein, 11 aa, Homo sapiens
  heavy chain complementarity determining region 3 for antibody 58815
ATGSPVLWFGD

SEQ ID NO: 117631 - protein, 9 aa, Homo sapiens
  light chain complementarity determining region 3 for antibody 58816
LQDYNYPWT

SEQ ID NO: 117632 - protein, 11 aa, Homo sapiens
  heavy chain complementarity determining region 3 for antibody 58816
ATGSPLQWFGD

SEQ ID NO: 117633 - protein, 9 aa, Homo sapiens
  light chain complementarity determining region 3 for antibody 58817
LQDYNYPWT

SEQ ID NO: 117634 - protein, 11 aa, Homo sapiens
  heavy chain complementarity determining region 3 for antibody 58817
ATGAPLRWFGD

SEQ ID NO: 117635 - protein, 9 aa, Homo sapiens
  light chain complementarity determining region 3 for antibody 58818
LQDYNYPWT

SEQ ID NO: 117636 - protein, 11 aa, Homo sapiens
  heavy chain complementarity determining region 3 for antibody 58818
ASGSPFLWFGD

SEQ ID NO: 117637 - protein, 9 aa, Homo sapiens
  light chain complementarity determining region 3 for antibody 58819
LQDYNYPWT

SEQ ID NO: 117638 - protein, 13 aa, Homo sapiens
  heavy chain complementarity determining region 3 for antibody 58819
ARVRITGTYAFDL

SEQ ID NO: 117639 - protein, 9 aa, Homo sapiens
  light chain complementarity determining region 3 for antibody 58820
LQDYNYPWT

SEQ ID NO: 117640 - protein, 9 aa, Homo sapiens
  heavy chain complementarity determining region 3 for antibody 58820
ARSPPYLAA

SEQ ID NO: 117641 - protein, 9 aa, Homo sapiens
  light chain complementarity determining region 3 for antibody 58821
LQDYNYPWT

SEQ ID NO: 117642 - protein, 8 aa, Homo sapiens
  heavy chain complementarity determining region 3 for antibody 58821
ARKKSMDV

SEQ ID NO: 117643 - protein, 9 aa, Homo sapiens
  light chain complementarity determining region 3 for antibody 58822
LQDYNYPWT

SEQ ID NO: 117644 - protein, 11 aa, Homo sapiens
  heavy chain complementarity determining region 3 for antibody 58822
ARGSPLLWFGD

SEQ ID NO: 117645 - protein, 9 aa, Homo sapiens
  light chain complementarity determining region 3 for antibody 58823
LQDYNYPWT

SEQ ID NO: 117646 - protein, 17 aa, Homo sapiens
  heavy chain complementarity determining region 3 for antibody 58823
ARGEGKLRYFDWLLRDY

SEQ ID NO: 117647 - protein, 9 aa, Homo sapiens
  light chain complementarity determining region 3 for antibody 58824
LQDYNYPWT

SEQ ID NO: 117648 - protein, 13 aa, Homo sapiens
  heavy chain complementarity determining region 3 for antibody 58824
AREYSGYDADFDY

SEQ ID NO: 117649 - protein, 9 aa, Homo sapiens
  light chain complementarity determining region 3 for antibody 58825
LQDYNYPWT

SEQ ID NO: 117650 - protein, 13 aa, Homo sapiens
  heavy chain complementarity determining region 3 for antibody 58825
AREYSGYAAHFDY

SEQ ID NO: 117651 - protein, 9 aa, Homo sapiens
  light chain complementarity determining region 3 for antibody 58826
LQDYNYPWT

SEQ ID NO: 117652 - protein, 13 aa, Homo sapiens
  heavy chain complementarity determining region 3 for antibody 58826
AREEVNWGGFFDY

SEQ ID NO: 117653 - protein, 9 aa, Homo sapiens
  light chain complementarity determining region 3 for antibody 58827
LQDYNYPWT

SEQ ID NO: 117654 - protein, 13 aa, Homo sapiens
  heavy chain complementarity determining region 3 for antibody 58827
AREEVNWGDFFDY

SEQ ID NO: 117655 - protein, 9 aa, Homo sapiens
  light chain complementarity determining region 3 for antibody 58828
LQDYNYPWT

SEQ ID NO: 117656 - protein, 22 aa, Homo sapiens
  heavy chain complementarity determining region 3 for antibody 58828
ARDVRDYDIWTGYYNGKNYFDY

SEQ ID NO: 117657 - protein, 9 aa, Homo sapiens
  light chain complementarity determining region 3 for antibody 58829
LQDYNYPWT

SEQ ID NO: 117658 - protein, 22 aa, Homo sapiens
  heavy chain complementarity determining region 3 for antibody 58829
ARDVRDYDILTGYYNGKYYFDY

SEQ ID NO: 117659 - protein, 9 aa, Homo sapiens
  light chain complementarity determining region 3 for antibody 58830
LQDYNYPWT

SEQ ID NO: 117660 - protein, 10 aa, Homo sapiens
  heavy chain complementarity determining region 3 for antibody 58830
ARDRVGATQY

SEQ ID NO: 117661 - protein, 9 aa, Homo sapiens
  light chain complementarity determining region 3 for antibody 58831
LQDYNYPWT

SEQ ID NO: 117662 - protein, 17 aa, Homo sapiens
  heavy chain complementarity determining region 3 for antibody 58831
ARDRLVRGVDYYSGMDV

SEQ ID NO: 117663 - protein, 9 aa, Homo sapiens
  light chain complementarity determining region 3 for antibody 58832
LQDYNYPWT

SEQ ID NO: 117664 - protein, 17 aa, Homo sapiens
  heavy chain complementarity determining region 3 for antibody 58832
ARDRLVRGVAYYYGMDV

SEQ ID NO: 117665 - protein, 9 aa, Homo sapiens
  light chain complementarity determining region 3 for antibody 58833
LQDYNYPWT

SEQ ID NO: 117666 - protein, 17 aa, Homo sapiens
  heavy chain complementarity determining region 3 for antibody 58833
ARDRLGRGVDYYYGMDV

SEQ ID NO: 117667 - protein, 9 aa, Homo sapiens
  light chain complementarity determining region 3 for antibody 58834
LQDYNYPWT

SEQ ID NO: 117668 - protein, 11 aa, Homo sapiens
  heavy chain complementarity determining region 3 for antibody 58834
ARDAYDSGLDV

SEQ ID NO: 117669 - protein, 9 aa, Homo sapiens
  light chain complementarity determining region 3 for antibody 58835
LQDYNYPWT

SEQ ID NO: 117670 - protein, 11 aa, Homo sapiens
  heavy chain complementarity determining region 3 for antibody 58835
ARAERGGYFDY

SEQ ID NO: 117671 - protein, 9 aa, Homo sapiens
  light chain complementarity determining region 3 for antibody 58836
LQDYNYPWT

SEQ ID NO: 117672 - protein, 17 aa, Homo sapiens
  heavy chain complementarity determining region 3 for antibody 58836
APVLRYFDWLFPNWFDP

SEQ ID NO: 117673 - protein, 9 aa, Homo sapiens
  light chain complementarity determining region 3 for antibody 58837
LQDYNYPWT

SEQ ID NO: 117674 - protein, 11 aa, Homo sapiens
  heavy chain complementarity determining region 3 for antibody 58837
APGSPLLWFAD

SEQ ID NO: 117675 - protein, 9 aa, Homo sapiens
  light chain complementarity determining region 3 for antibody 58838
LQDYNYPWT

SEQ ID NO: 117676 - protein, 10 aa, Homo sapiens
  heavy chain complementarity determining region 3 for antibody 58838
AKEGYQSGDY

SEQ ID NO: 117677 - protein, 9 aa, Homo sapiens
  light chain complementarity determining region 3 for antibody 58839
LQDYNYPWT

SEQ ID NO: 117678 - protein, 14 aa, Homo sapiens
  heavy chain complementarity determining region 3 for antibody 58839
AGRPYDILTGFSDY

SEQ ID NO: 117679 - protein, 9 aa, Homo sapiens
  light chain complementarity determining region 3 for antibody 58840
LQDYNYPWT

SEQ ID NO: 117680 - protein, 14 aa, Homo sapiens
  heavy chain complementarity determining region 3 for antibody 58840
AGRHYDNLTGFSDY

SEQ ID NO: 117681 - protein, 9 aa, Homo sapiens
  light chain complementarity determining region 3 for antibody 58841
LQDYNYPWT

SEQ ID NO: 117682 - protein, 14 aa, Homo sapiens
  heavy chain complementarity determining region 3 for antibody 58841
AGRHYDIVTGFSDY

SEQ ID NO: 117683 - protein, 9 aa, Homo sapiens
  light chain complementarity determining region 3 for antibody 58842
LQDYNYPWT

SEQ ID NO: 117684 - protein, 14 aa, Homo sapiens
  heavy chain complementarity determining region 3 for antibody 58842
AGRHYDILTGSSDY

SEQ ID NO: 117685 - protein, 9 aa, Homo sapiens
  light chain complementarity determining region 3 for antibody 58843
LQDYNYPWT

SEQ ID NO: 117686 - protein, 14 aa, Homo sapiens
  heavy chain complementarity determining region 3 for antibody 58843
AGRHYDILTGFYDY

SEQ ID NO: 117687 - protein, 9 aa, Homo sapiens
  light chain complementarity determining region 3 for antibody 58844
LQDYNYPWT

SEQ ID NO: 117688 - protein, 14 aa, Homo sapiens
  heavy chain complementarity determining region 3 for antibody 58844
AGRHYDILTGFFDY

SEQ ID NO: 117689 - protein, 9 aa, Homo sapiens
  light chain complementarity determining region 3 for antibody 58845
LQDYNYPWT

SEQ ID NO: 117690 - protein, 14 aa, Homo sapiens
  heavy chain complementarity determining region 3 for antibody 58845
AGCHYDILTGFSDY

SEQ ID NO: 117691 - protein, 9 aa, Homo sapiens
  light chain complementarity determining region 3 for antibody 58846
LQDYNYPRT

SEQ ID NO: 117692 - protein, 11 aa, Homo sapiens
  heavy chain complementarity determining region 3 for antibody 58846
TRETLERGFDY

SEQ ID NO: 117693 - protein, 9 aa, Homo sapiens
  light chain complementarity determining region 3 for antibody 58847
LQDYNYPRT

SEQ ID NO: 117694 - protein, 9 aa, Homo sapiens
  heavy chain complementarity determining region 3 for antibody 58847
ASDGGGGSY

SEQ ID NO: 117695 - protein, 9 aa, Homo sapiens
  light chain complementarity determining region 3 for antibody 58848
LQDYNYPRT

SEQ ID NO: 117696 - protein, 19 aa, Homo sapiens
  heavy chain complementarity determining region 3 for antibody 58848
ARELPYYDILTGYYPLFDY

SEQ ID NO: 117697 - protein, 9 aa, Homo sapiens
  light chain complementarity determining region 3 for antibody 58849
LQDYNYPRT

SEQ ID NO: 117698 - protein, 14 aa, Homo sapiens
  heavy chain complementarity determining region 3 for antibody 58849
ARDRYSGSGSDFDY

SEQ ID NO: 117699 - protein, 9 aa, Homo sapiens
  light chain complementarity determining region 3 for antibody 58850
LQDYNYPRT

SEQ ID NO: 117700 - protein, 14 aa, Homo sapiens
  heavy chain complementarity determining region 3 for antibody 58850
ARDRYSGSGRYFDY

SEQ ID NO: 117701 - protein, 9 aa, Homo sapiens
  light chain complementarity determining region 3 for antibody 58851
LQDYNYPRT

SEQ ID NO: 117702 - protein, 14 aa, Homo sapiens
  heavy chain complementarity determining region 3 for antibody 58851
ARDRYSGSASYFDY

SEQ ID NO: 117703 - protein, 9 aa, Homo sapiens
  light chain complementarity determining region 3 for antibody 58852
LQDYNYPRT

SEQ ID NO: 117704 - protein, 14 aa, Homo sapiens
  heavy chain complementarity determining region 3 for antibody 58852
ARDRYAGSGSYFDY

SEQ ID NO: 117705 - protein, 9 aa, Homo sapiens
  light chain complementarity determining region 3 for antibody 58853
LQDYNYPRT

SEQ ID NO: 117706 - protein, 14 aa, Homo sapiens
  heavy chain complementarity determining region 3 for antibody 58853
ARDRCSGSGSYFDY

SEQ ID NO: 117707 - protein, 9 aa, Homo sapiens
  light chain complementarity determining region 3 for antibody 58854
LQDYNYPRT

SEQ ID NO: 117708 - protein, 19 aa, Homo sapiens
  heavy chain complementarity determining region 3 for antibody 58854
ARDLPYYDILTGYSPLFDY

SEQ ID NO: 117709 - protein, 9 aa, Homo sapiens
  light chain complementarity determining region 3 for antibody 58855
LQDYNYPRT

SEQ ID NO: 117710 - protein, 14 aa, Homo sapiens
  heavy chain complementarity determining region 3 for antibody 58855
ARDHGIAGATPFDY

SEQ ID NO: 117711 - protein, 9 aa, Homo sapiens
  light chain complementarity determining region 3 for antibody 58856
LQDYNYPRT

SEQ ID NO: 117712 - protein, 17 aa, Homo sapiens
  heavy chain complementarity determining region 3 for antibody 58856
ARDESITMVRGVRGMDV

SEQ ID NO: 117713 - protein, 9 aa, Homo sapiens
  light chain complementarity determining region 3 for antibody 58857
LQDYNYPRT

SEQ ID NO: 117714 - protein, 19 aa, Homo sapiens
  heavy chain complementarity determining region 3 for antibody 58857
ARDAFLYYDILNYYYGMDV

SEQ ID NO: 117715 - protein, 9 aa, Homo sapiens
  light chain complementarity determining region 3 for antibody 58858
LQDYNYPRT

SEQ ID NO: 117716 - protein, 18 aa, Homo sapiens
  heavy chain complementarity determining region 3 for antibody 58858
ANDRLAYCGGDCYSNFDY

SEQ ID NO: 117717 - protein, 9 aa, Homo sapiens
  light chain complementarity determining region 3 for antibody 58859
LQDYNYPRT

SEQ ID NO: 117718 - protein, 13 aa, Homo sapiens
  heavy chain complementarity determining region 3 for antibody 58859
ALNYGDYGDWFDH

SEQ ID NO: 117719 - protein, 9 aa, Homo sapiens
  light chain complementarity determining region 3 for antibody 58860
LQDYNYPRT

SEQ ID NO: 117720 - protein, 18 aa, Homo sapiens
  heavy chain complementarity determining region 3 for antibody 58860
AKDRLAYCGGDCYSTFDY

SEQ ID NO: 117721 - protein, 9 aa, Homo sapiens
  light chain complementarity determining region 3 for antibody 58861
LQDYNYPRT

SEQ ID NO: 117722 - protein, 18 aa, Homo sapiens
  heavy chain complementarity determining region 3 for antibody 58861
AKDRLAYCGGDCYSDFDY

SEQ ID NO: 117723 - protein, 9 aa, Homo sapiens
  light chain complementarity determining region 3 for antibody 58862
LQDYNYPRT

SEQ ID NO: 117724 - protein, 18 aa, Homo sapiens
  heavy chain complementarity determining region 3 for antibody 58862
AKDRLADCGGDCYSNFDY

SEQ ID NO: 117725 - protein, 9 aa, Homo sapiens
  light chain complementarity determining region 3 for antibody 58863
LQDYNYPRT

SEQ ID NO: 117726 - protein, 14 aa, Homo sapiens
  heavy chain complementarity determining region 3 for antibody 58863
AGDRYSGSGSYFDY

SEQ ID NO: 117727 - protein, 9 aa, Homo sapiens
  light chain complementarity determining region 3 for antibody 58864
LQDYNYPRT

SEQ ID NO: 117728 - protein, 14 aa, Homo sapiens
  heavy chain complementarity determining region 3 for antibody 58864
AGDHGIVGATPFDY

SEQ ID NO: 117729 - protein, 9 aa, Homo sapiens
  light chain complementarity determining region 3 for antibody 58865
LQDYNYPPT

SEQ ID NO: 117730 - protein, 15 aa, Homo sapiens
  heavy chain complementarity determining region 3 for antibody 58865
ARGLRYFDWLGGMDV

SEQ ID NO: 117731 - protein, 9 aa, Homo sapiens
  light chain complementarity determining region 3 for antibody 58866
LQDYNYPLT

SEQ ID NO: 117732 - protein, 10 aa, Homo sapiens
  heavy chain complementarity determining region 3 for antibody 58866
VRRTTVIFDY

SEQ ID NO: 117733 - protein, 9 aa, Homo sapiens
  light chain complementarity determining region 3 for antibody 58867
LQDYNYPLT

SEQ ID NO: 117734 - protein, 10 aa, Homo sapiens
  heavy chain complementarity determining region 3 for antibody 58867
VRMTTGIFDY

SEQ ID NO: 117735 - protein, 9 aa, Homo sapiens
  light chain complementarity determining region 3 for antibody 58868
LQDYNYPLT

SEQ ID NO: 117736 - protein, 10 aa, Homo sapiens
  heavy chain complementarity determining region 3 for antibody 58868
VRMTSVIFDY

SEQ ID NO: 117737 - protein, 9 aa, Homo sapiens
  light chain complementarity determining region 3 for antibody 58869
LQDYNYPLT

SEQ ID NO: 117738 - protein, 10 aa, Homo sapiens
  heavy chain complementarity determining region 3 for antibody 58869
VRMTPVIFDY

SEQ ID NO: 117739 - protein, 9 aa, Homo sapiens
  light chain complementarity determining region 3 for antibody 58870
LQDYNYPHT

SEQ ID NO: 117740 - protein, 10 aa, Homo sapiens
  heavy chain complementarity determining region 3 for antibody 58870
AISLAAPKDF

SEQ ID NO: 117741 - protein, 9 aa, Homo sapiens
  light chain complementarity determining region 3 for antibody 58871
LQDYNYPFT

SEQ ID NO: 117742 - protein, 15 aa, Homo sapiens
  heavy chain complementarity determining region 3 for antibody 58871
ASLTMVRGVMGSFDL

SEQ ID NO: 117743 - protein, 9 aa, Homo sapiens
  light chain complementarity determining region 3 for antibody 58872
LQDYNYPFT

SEQ ID NO: 117744 - protein, 13 aa, Homo sapiens
  heavy chain complementarity determining region 3 for antibody 58872
ARDLTGTSNWLDP

SEQ ID NO: 117745 - protein, 9 aa, Homo sapiens
  light chain complementarity determining region 3 for antibody 58873
LQDYNYPFT

SEQ ID NO: 117746 - protein, 13 aa, Homo sapiens
  heavy chain complementarity determining region 3 for antibody 58873
ARDLTGSSNWFDP

SEQ ID NO: 117747 - protein, 8 aa, Homo sapiens
  light chain complementarity determining region 3 for antibody 58874
LQDYNFYT

SEQ ID NO: 117748 - protein, 9 aa, Homo sapiens
  heavy chain complementarity determining region 3 for antibody 58874
ARDRESFDY

SEQ ID NO: 117749 - protein, 8 aa, Homo sapiens
  light chain complementarity determining region 3 for antibody 58875
LQDYNFYT

SEQ ID NO: 117750 - protein, 9 aa, Homo sapiens
  heavy chain complementarity determining region 3 for antibody 58875
ARDPEFFDY

SEQ ID NO: 117751 - protein, 9 aa, Homo sapiens
  light chain complementarity determining region 3 for antibody 58876
LQDHNYPYT

SEQ ID NO: 117752 - protein, 22 aa, Homo sapiens
  heavy chain complementarity determining region 3 for antibody 58876
ARDVRDYDILTGYYNGGNYFDY

SEQ ID NO: 117753 - protein, 9 aa, Homo sapiens
  light chain complementarity determining region 3 for antibody 58877
LQAYNYPWT

SEQ ID NO: 117754 - protein, 14 aa, Homo sapiens
  heavy chain complementarity determining region 3 for antibody 58877
AGRYYDSLTGYHDY

SEQ ID NO: 117755 - protein, 9 aa, Homo sapiens
  light chain complementarity determining region 3 for antibody 58878
LQAYNYPWT

SEQ ID NO: 117756 - protein, 14 aa, Homo sapiens
  heavy chain complementarity determining region 3 for antibody 58878
AGRYYDILTGDHDY

SEQ ID NO: 117757 - protein, 9 aa, Homo sapiens
  light chain complementarity determining region 3 for antibody 58879
LQAYNYPWT

SEQ ID NO: 117758 - protein, 14 aa, Homo sapiens
  heavy chain complementarity determining region 3 for antibody 58879
AGGYYDILTGYHDY

SEQ ID NO: 117759 - protein, 9 aa, Homo sapiens
  light chain complementarity determining region 3 for antibody 58880
KQYNNWPLT

SEQ ID NO: 117760 - protein, 18 aa, Homo sapiens
  heavy chain complementarity determining region 3 for antibody 58880
TRDLRPPGIAVAEGAFDI

SEQ ID NO: 117761 - protein, 9 aa, Homo sapiens
  light chain complementarity determining region 3 for antibody 58881
IQHNSYPLT

SEQ ID NO: 117762 - protein, 14 aa, Homo sapiens
  heavy chain complementarity determining region 3 for antibody 58881
ATGGASYYYYGMDV

SEQ ID NO: 117763 - protein, 9 aa, Homo sapiens
  light chain complementarity determining region 3 for antibody 58882
HQYNSYPFT

SEQ ID NO: 117764 - protein, 13 aa, Homo sapiens
  heavy chain complementarity determining region 3 for antibody 58882
ARERWAANTGFDY

SEQ ID NO: 117765 - protein, 9 aa, Homo sapiens
  light chain complementarity determining region 3 for antibody 58883
HQYNSYPFT

SEQ ID NO: 117766 - protein, 13 aa, Homo sapiens
  heavy chain complementarity determining region 3 for antibody 58883
ARERWAANTCFDD

SEQ ID NO: 117767 - protein, 9 aa, Homo sapiens
  light chain complementarity determining region 3 for antibody 58884
HQYNSYPFT

SEQ ID NO: 117768 - protein, 13 aa, Homo sapiens
  heavy chain complementarity determining region 3 for antibody 58884
ARERWAANTCFAY

SEQ ID NO: 117769 - protein, 9 aa, Homo sapiens
  light chain complementarity determining region 3 for antibody 58885
HQYNSYPFT

SEQ ID NO: 117770 - protein, 13 aa, Homo sapiens
  heavy chain complementarity determining region 3 for antibody 58885
ARERLAANTCFDY

SEQ ID NO: 117771 - protein, 9 aa, Homo sapiens
  light chain complementarity determining region 3 for antibody 58886
HQYNSYPFT

SEQ ID NO: 117772 - protein, 13 aa, Homo sapiens
  heavy chain complementarity determining region 3 for antibody 58886
ARERCAANTCFDY

SEQ ID NO: 117773 - protein, 9 aa, Homo sapiens
  light chain complementarity determining region 3 for antibody 58887
HQSTSLPHT

SEQ ID NO: 117774 - protein, 13 aa, Homo sapiens
  heavy chain complementarity determining region 3 for antibody 58887
ARGGYYGSGSLDY

SEQ ID NO: 117775 - protein, 9 aa, Homo sapiens
  light chain complementarity determining region 3 for antibody 58888
HQSSSLPYT

SEQ ID NO: 117776 - protein, 10 aa, Homo sapiens
  heavy chain complementarity determining region 3 for antibody 58888
TRDGQWLGDY

SEQ ID NO: 117777 - protein, 9 aa, Homo sapiens
  light chain complementarity determining region 3 for antibody 58889
HQSSSLPYT

SEQ ID NO: 117778 - protein, 11 aa, Homo sapiens
  heavy chain complementarity determining region 3 for antibody 58889
ARCNWNGYFDY

SEQ ID NO: 117779 - protein, 9 aa, Homo sapiens
  light chain complementarity determining region 3 for antibody 58890
HQSSSLPYT

SEQ ID NO: 117780 - protein, 14 aa, Homo sapiens
  heavy chain complementarity determining region 3 for antibody 58890
ARALYGSGSGYFDY

SEQ ID NO: 117781 - protein, 9 aa, Homo sapiens
  light chain complementarity determining region 3 for antibody 58891
HQSSSLPWT

SEQ ID NO: 117782 - protein, 15 aa, Homo sapiens
  heavy chain complementarity determining region 3 for antibody 58891
ARGAIIDWLLYYFDY

SEQ ID NO: 117783 - protein, 9 aa, Homo sapiens
  light chain complementarity determining region 3 for antibody 58892
HQSSSLPWT

SEQ ID NO: 117784 - protein, 11 aa, Homo sapiens
  heavy chain complementarity determining region 3 for antibody 58892
AREGIFDAFDI

SEQ ID NO: 117785 - protein, 8 aa, Homo sapiens
  light chain complementarity determining region 3 for antibody 58893
HQSSSLPT

SEQ ID NO: 117786 - protein, 13 aa, Homo sapiens
  heavy chain complementarity determining region 3 for antibody 58893
ARDQDYGSGSTDY

SEQ ID NO: 117787 - protein, 9 aa, Homo sapiens
  light chain complementarity determining region 3 for antibody 58894
HQSSSLPLT

SEQ ID NO: 117788 - protein, 13 aa, Homo sapiens
  heavy chain complementarity determining region 3 for antibody 58894
ARGVYYGSGSLDY

SEQ ID NO: 117789 - protein, 9 aa, Homo sapiens
  light chain complementarity determining region 3 for antibody 58895
HQSSSLPLT

SEQ ID NO: 117790 - protein, 13 aa, Homo sapiens
  heavy chain complementarity determining region 3 for antibody 58895
ARGGYYSSGSLDY

SEQ ID NO: 117791 - protein, 9 aa, Homo sapiens
  light chain complementarity determining region 3 for antibody 58896
HQSSSLPLT

SEQ ID NO: 117792 - protein, 13 aa, Homo sapiens
  heavy chain complementarity determining region 3 for antibody 58896
ARGGYYGSRSLDY

SEQ ID NO: 117793 - protein, 9 aa, Homo sapiens
  light chain complementarity determining region 3 for antibody 58897
HQSSSLPLT

SEQ ID NO: 117794 - protein, 13 aa, Homo sapiens
  heavy chain complementarity determining region 3 for antibody 58897
ARGGYYGSGGLDD

SEQ ID NO: 117795 - protein, 9 aa, Homo sapiens
  light chain complementarity determining region 3 for antibody 58898
HQSSSLPLT

SEQ ID NO: 117796 - protein, 13 aa, Homo sapiens
  heavy chain complementarity determining region 3 for antibody 58898
ARGGYYGSGCLDY

SEQ ID NO: 117797 - protein, 9 aa, Homo sapiens
  light chain complementarity determining region 3 for antibody 58899
HQSSSLPLT

SEQ ID NO: 117798 - protein, 13 aa, Homo sapiens
  heavy chain complementarity determining region 3 for antibody 58899
ARGGYYASGSLDY

SEQ ID NO: 117799 - protein, 9 aa, Homo sapiens
  light chain complementarity determining region 3 for antibody 58900
HQSSSLPLT

SEQ ID NO: 117800 - protein, 5 aa, Homo sapiens
  heavy chain complementarity determining region 3 for antibody 58900
ARGGY

SEQ ID NO: 117801 - protein, 9 aa, Homo sapiens
  light chain complementarity determining region 3 for antibody 58901
HQSSSLPLT

SEQ ID NO: 117802 - protein, 13 aa, Homo sapiens
  heavy chain complementarity determining region 3 for antibody 58901
ARGGSYGSGSLDY

SEQ ID NO: 117803 - protein, 9 aa, Homo sapiens
  light chain complementarity determining region 3 for antibody 58902
HQSSSLPLT

SEQ ID NO: 117804 - protein, 13 aa, Homo sapiens
  heavy chain complementarity determining region 3 for antibody 58902
ARGGCYGSGSLDY

SEQ ID NO: 117805 - protein, 9 aa, Homo sapiens
  light chain complementarity determining region 3 for antibody 58903
HQSSSLPLT

SEQ ID NO: 117806 - protein, 16 aa, Homo sapiens
  heavy chain complementarity determining region 3 for antibody 58903
AREPRYDILTYDAFDI

SEQ ID NO: 117807 - protein, 9 aa, Homo sapiens
  light chain complementarity determining region 3 for antibody 58904
HQSSSLPHT

SEQ ID NO: 117808 - protein, 10 aa, Homo sapiens
  heavy chain complementarity determining region 3 for antibody 58904
VRMTTVIFDY

SEQ ID NO: 117809 - protein, 9 aa, Homo sapiens
  light chain complementarity determining region 3 for antibody 58905
HQSSSLPHT

SEQ ID NO: 117810 - protein, 13 aa, Homo sapiens
  heavy chain complementarity determining region 3 for antibody 58905
VRGGYYGSGSLDY

SEQ ID NO: 117811 - protein, 9 aa, Homo sapiens
  light chain complementarity determining region 3 for antibody 58906
HQSSSLPHT

SEQ ID NO: 117812 - protein, 13 aa, Homo sapiens
  heavy chain complementarity determining region 3 for antibody 58906
ARVGYYGSGSLDY

SEQ ID NO: 117813 - protein, 9 aa, Homo sapiens
  light chain complementarity determining region 3 for antibody 58907
HQSSSLPHT

SEQ ID NO: 117814 - protein, 13 aa, Homo sapiens
  heavy chain complementarity determining region 3 for antibody 58907
ARRGYYGSGSLDY

SEQ ID NO: 117815 - protein, 9 aa, Homo sapiens
  light chain complementarity determining region 3 for antibody 58908
HQSSSLPHT

SEQ ID NO: 117816 - protein, 13 aa, Homo sapiens
  heavy chain complementarity determining region 3 for antibody 58908
ARGGYYVSGSLAY

SEQ ID NO: 117817 - protein, 9 aa, Homo sapiens
  light chain complementarity determining region 3 for antibody 58909
HQSSSLPHT

SEQ ID NO: 117818 - protein, 13 aa, Homo sapiens
  heavy chain complementarity determining region 3 for antibody 58909
ARGGYYGSWGLDY

SEQ ID NO: 117819 - protein, 9 aa, Homo sapiens
  light chain complementarity determining region 3 for antibody 58910
HQSSSLPHT

SEQ ID NO: 117820 - protein, 13 aa, Homo sapiens
  heavy chain complementarity determining region 3 for antibody 58910
ARGGYYGSGSLNY

SEQ ID NO: 117821 - protein, 9 aa, Homo sapiens
  light chain complementarity determining region 3 for antibody 58911
HQSSSLPHT

SEQ ID NO: 117822 - protein, 13 aa, Homo sapiens
  heavy chain complementarity determining region 3 for antibody 58911
ARGGYYGSGSIAY

SEQ ID NO: 117823 - protein, 9 aa, Homo sapiens
  light chain complementarity determining region 3 for antibody 58912
HQSSSLPHT

SEQ ID NO: 117824 - protein, 13 aa, Homo sapiens
  heavy chain complementarity determining region 3 for antibody 58912
ARGGYYGSGGLDS

SEQ ID NO: 117825 - protein, 9 aa, Homo sapiens
  light chain complementarity determining region 3 for antibody 58913
HQSSSLPHT

SEQ ID NO: 117826 - protein, 13 aa, Homo sapiens
  heavy chain complementarity determining region 3 for antibody 58913
ARGGYYASGSIDY

SEQ ID NO: 117827 - protein, 9 aa, Homo sapiens
  light chain complementarity determining region 3 for antibody 58914
HQSSSLPHT

SEQ ID NO: 117828 - protein, 13 aa, Homo sapiens
  heavy chain complementarity determining region 3 for antibody 58914
ARGGYSGSGRLDY

SEQ ID NO: 117829 - protein, 9 aa, Homo sapiens
  light chain complementarity determining region 3 for antibody 58915
HQSSSLPHT

SEQ ID NO: 117830 - protein, 13 aa, Homo sapiens
  heavy chain complementarity determining region 3 for antibody 58915
ARGGYNGSGGLDY

SEQ ID NO: 117831 - protein, 9 aa, Homo sapiens
  light chain complementarity determining region 3 for antibody 58916
HQSSSLPHT

SEQ ID NO: 117832 - protein, 13 aa, Homo sapiens
  heavy chain complementarity determining region 3 for antibody 58916
ARGGYDGSGSRDY

SEQ ID NO: 117833 - protein, 9 aa, Homo sapiens
  light chain complementarity determining region 3 for antibody 58917
HQSSSLPHT

SEQ ID NO: 117834 - protein, 13 aa, Homo sapiens
  heavy chain complementarity determining region 3 for antibody 58917
ARGGYDGSGRLDY

SEQ ID NO: 117835 - protein, 9 aa, Homo sapiens
  light chain complementarity determining region 3 for antibody 58918
HQSSSLPHT

SEQ ID NO: 117836 - protein, 13 aa, Homo sapiens
  heavy chain complementarity determining region 3 for antibody 58918
ARGGSYGSGSLDD

SEQ ID NO: 117837 - protein, 9 aa, Homo sapiens
  light chain complementarity determining region 3 for antibody 58919
HQSSSLPHT

SEQ ID NO: 117838 - protein, 13 aa, Homo sapiens
  heavy chain complementarity determining region 3 for antibody 58919
ARGGSYGSGRLDY

SEQ ID NO: 117839 - protein, 9 aa, Homo sapiens
  light chain complementarity determining region 3 for antibody 58920
HQSSSLPHT

SEQ ID NO: 117840 - protein, 13 aa, Homo sapiens
  heavy chain complementarity determining region 3 for antibody 58920
ARGGSYGSGGLDY

SEQ ID NO: 117841 - protein, 9 aa, Homo sapiens
  light chain complementarity determining region 3 for antibody 58921
HQSSSLPHT

SEQ ID NO: 117842 - protein, 13 aa, Homo sapiens
  heavy chain complementarity determining region 3 for antibody 58921
ARGGDYGSGSRDY

SEQ ID NO: 117843 - protein, 9 aa, Homo sapiens
  light chain complementarity determining region 3 for antibody 58922
HQSSSLPHT

SEQ ID NO: 117844 - protein, 13 aa, Homo sapiens
  heavy chain complementarity determining region 3 for antibody 58922
ARGGDDGSGSLDY

SEQ ID NO: 117845 - protein, 9 aa, Homo sapiens
  light chain complementarity determining region 3 for antibody 58923
HQSSSLPHT

SEQ ID NO: 117846 - protein, 13 aa, Homo sapiens
  heavy chain complementarity determining region 3 for antibody 58923
ARGGCYGSWGLDY

SEQ ID NO: 117847 - protein, 9 aa, Homo sapiens
  light chain complementarity determining region 3 for antibody 58924
HQSSSLPHT

SEQ ID NO: 117848 - protein, 15 aa, Homo sapiens
  heavy chain complementarity determining region 3 for antibody 58924
AREWNDVPYYYGMDV

SEQ ID NO: 117849 - protein, 9 aa, Homo sapiens
  light chain complementarity determining region 3 for antibody 58925
HQSSSLPHT

SEQ ID NO: 117850 - protein, 20 aa, Homo sapiens
  heavy chain complementarity determining region 3 for antibody 58925
AKDGLRLGELSLGLYWYFDL

SEQ ID NO: 117851 - protein, 9 aa, Homo sapiens
  light chain complementarity determining region 3 for antibody 58926
HQSSSLPHT

SEQ ID NO: 117852 - protein, 13 aa, Homo sapiens
  heavy chain complementarity determining region 3 for antibody 58926
AGGGYYVSGSLDY

SEQ ID NO: 117853 - protein, 9 aa, Homo sapiens
  light chain complementarity determining region 3 for antibody 58927
HQSSSLPHT

SEQ ID NO: 117854 - protein, 13 aa, Homo sapiens
  heavy chain complementarity determining region 3 for antibody 58927
AGGGYYGSGSIDY

SEQ ID NO: 117855 - protein, 9 aa, Homo sapiens
  light chain complementarity determining region 3 for antibody 58928
HQSSSLPHA

SEQ ID NO: 117856 - protein, 13 aa, Homo sapiens
  heavy chain complementarity determining region 3 for antibody 58928
ARGGYYGSGSLDY

SEQ ID NO: 117857 - protein, 9 aa, Homo sapiens
  light chain complementarity determining region 3 for antibody 58929
HQSSSLHHT

SEQ ID NO: 117858 - protein, 13 aa, Homo sapiens
  heavy chain complementarity determining region 3 for antibody 58929
ARGGYYGSGSLDY

SEQ ID NO: 117859 - protein, 9 aa, Homo sapiens
  light chain complementarity determining region 3 for antibody 58930
HQSSSFPWT

SEQ ID NO: 117860 - protein, 12 aa, Homo sapiens
  heavy chain complementarity determining region 3 for antibody 58930
AREGNWGSDFDY

SEQ ID NO: 117861 - protein, 9 aa, Homo sapiens
  light chain complementarity determining region 3 for antibody 58931
HQSSSFPHT

SEQ ID NO: 117862 - protein, 13 aa, Homo sapiens
  heavy chain complementarity determining region 3 for antibody 58931
ARGGYYGSGSIDY

SEQ ID NO: 117863 - protein, 9 aa, Homo sapiens
  light chain complementarity determining region 3 for antibody 58932
HQSSGLPHT

SEQ ID NO: 117864 - protein, 13 aa, Homo sapiens
  heavy chain complementarity determining region 3 for antibody 58932
ARGGYYGSGGLDY

SEQ ID NO: 117865 - protein, 9 aa, Homo sapiens
  light chain complementarity determining region 3 for antibody 58933
HQSSCLPHT

SEQ ID NO: 117866 - protein, 13 aa, Homo sapiens
  heavy chain complementarity determining region 3 for antibody 58933
ARGGYYGSGSLEY

SEQ ID NO: 117867 - protein, 9 aa, Homo sapiens
  light chain complementarity determining region 3 for antibody 58934
HQRSSLPLT

SEQ ID NO: 117868 - protein, 13 aa, Homo sapiens
  heavy chain complementarity determining region 3 for antibody 58934
ARGGYYGSGSLDY

SEQ ID NO: 117869 - protein, 9 aa, Homo sapiens
  light chain complementarity determining region 3 for antibody 58935
HQRSSFPHT

SEQ ID NO: 117870 - protein, 13 aa, Homo sapiens
  heavy chain complementarity determining region 3 for antibody 58935
ARGGYYGSGSLDY

SEQ ID NO: 117871 - protein, 9 aa, Homo sapiens
  light chain complementarity determining region 3 for antibody 58936
HQNSSLPHT

SEQ ID NO: 117872 - protein, 13 aa, Homo sapiens
  heavy chain complementarity determining region 3 for antibody 58936
ARGGYYGSGSLDY

SEQ ID NO: 117873 - protein, 9 aa, Homo sapiens
  light chain complementarity determining region 3 for antibody 58937
HQCSSLPHT

SEQ ID NO: 117874 - protein, 13 aa, Homo sapiens
  heavy chain complementarity determining region 3 for antibody 58937
ARGGYYGSGGLDY

SEQ ID NO: 117875 - protein, 9 aa, Homo sapiens
  light chain complementarity determining region 3 for antibody 58938
HKYNSAPWT

SEQ ID NO: 117876 - protein, 15 aa, Homo sapiens
  heavy chain complementarity determining region 3 for antibody 58938
AKAGDYYGSGSPFDY

SEQ ID NO: 117877 - protein, 9 aa, Homo sapiens
  light chain complementarity determining region 3 for antibody 58939
LQDYNYPRT

SEQ ID NO: 117878 - protein, 11 aa, Homo sapiens
  heavy chain complementarity determining region 3 for antibody 58939
TRETLERGFDY

SEQ ID NO: 117879 - protein, 9 aa, Homo sapiens
  light chain complementarity determining region 3 for antibody 58940
QQYDNLPYT

SEQ ID NO: 117880 - protein, 12 aa, Homo sapiens
  heavy chain complementarity determining region 3 for antibody 58940
ARAVAGYWYFDL

SEQ ID NO: 117881 - protein, 9 aa, Homo sapiens
  light chain complementarity determining region 3 for antibody 58941
LQHNSYPPT

SEQ ID NO: 117882 - protein, 17 aa, Homo sapiens
  heavy chain complementarity determining region 3 for antibody 58941
AREGNDILTGYYHAFDI

SEQ ID NO: 117883 - protein, 9 aa, Homo sapiens
  light chain complementarity determining region 3 for antibody 58942
QQLNSYPYT

SEQ ID NO: 117884 - protein, 19 aa, Homo sapiens
  heavy chain complementarity determining region 3 for antibody 58942
ARKGHYDILTGYYPDAFDI

SEQ ID NO: 117885 - protein, 9 aa, Homo sapiens
  light chain complementarity determining region 3 for antibody 58943
QQYNSYPYT

SEQ ID NO: 117886 - protein, 12 aa, Homo sapiens
  heavy chain complementarity determining region 3 for antibody 58943
ARVIGVWSPFDD

SEQ ID NO: 117887 - protein, 9 aa, Homo sapiens
  light chain complementarity determining region 3 for antibody 58944
LQDYIYPWT

SEQ ID NO: 117888 - protein, 11 aa, Homo sapiens
  heavy chain complementarity determining region 3 for antibody 58944
ARDGAVAGLDY

SEQ ID NO: 117889 - protein, 9 aa, Homo sapiens
  light chain complementarity determining region 3 for antibody 58945
LQDYNYPWT

SEQ ID NO: 117890 - protein, 11 aa, Homo sapiens
  heavy chain complementarity determining region 3 for antibody 58945
AREGALYGMDV

SEQ ID NO: 117891 - protein, 9 aa, Homo sapiens
  light chain complementarity determining region 3 for antibody 58946
QQYNSYPPT

SEQ ID NO: 117892 - protein, 12 aa, Homo sapiens
  heavy chain complementarity determining region 3 for antibody 58946
ARELEQQLVFDY

SEQ ID NO: 117893 - protein, 9 aa, Homo sapiens
  light chain complementarity determining region 3 for antibody 58947
LQDYNYPRT

SEQ ID NO: 117894 - protein, 11 aa, Homo sapiens
  heavy chain complementarity determining region 3 for antibody 58947
TRETLDRGFDY

SEQ ID NO: 117895 - protein, 9 aa, Homo sapiens
  light chain complementarity determining region 3 for antibody 58948
QQYDNLPYT

SEQ ID NO: 117896 - protein, 9 aa, Homo sapiens
  heavy chain complementarity determining region 3 for antibody 58948
AKDGAVAQH

SEQ ID NO: 117897 - protein, 9 aa, Homo sapiens
  light chain complementarity determining region 3 for antibody 58949
QQFNNYPYT

SEQ ID NO: 117898 - protein, 15 aa, Homo sapiens
  heavy chain complementarity determining region 3 for antibody 58949
AREGFGESLHWFFDL

SEQ ID NO: 117899 - protein, 9 aa, Homo sapiens
  light chain complementarity determining region 3 for antibody 58950
QQYKSYPYT

SEQ ID NO: 117900 - protein, 13 aa, Homo sapiens
  heavy chain complementarity determining region 3 for antibody 58950
ARERWEPGVYCEY

SEQ ID NO: 117901 - protein, 10 aa, Homo sapiens
  light chain complementarity determining region 3 for antibody 58951
QQFNSYPPYT

SEQ ID NO: 117902 - protein, 14 aa, Homo sapiens
  heavy chain complementarity determining region 3 for antibody 58951
ARDGRLTMVRGGDF

SEQ ID NO: 117903 - protein, 9 aa, Homo sapiens
  light chain complementarity determining region 3 for antibody 58952
LQHNNYPYT

SEQ ID NO: 117904 - protein, 12 aa, Homo sapiens
  heavy chain complementarity determining region 3 for antibody 58952
ARDVFLFFGEFP

SEQ ID NO: 117905 - protein, 9 aa, Homo sapiens
  light chain complementarity determining region 3 for antibody 58953
QQSYSTPFT

SEQ ID NO: 117906 - protein, 12 aa, Homo sapiens
  heavy chain complementarity determining region 3 for antibody 58953
ARLGWELHDFDY

SEQ ID NO: 117907 - protein, 9 aa, Homo sapiens
  light chain complementarity determining region 3 for antibody 58954
QQYNSYPYT

SEQ ID NO: 117908 - protein, 20 aa, Homo sapiens
  heavy chain complementarity determining region 3 for antibody 58954
AREGVAAVGRVYYFYYGMDV

SEQ ID NO: 117909 - protein, 9 aa, Homo sapiens
  light chain complementarity determining region 3 for antibody 58955
QQFNNYPHT

SEQ ID NO: 117910 - protein, 11 aa, Homo sapiens
  heavy chain complementarity determining region 3 for antibody 58955
ARDGYSYYFDY

SEQ ID NO: 117911 - protein, 9 aa, Homo sapiens
  light chain complementarity determining region 3 for antibody 58956
QQYNSYPRT

SEQ ID NO: 117912 - protein, 17 aa, Homo sapiens
  heavy chain complementarity determining region 3 for antibody 58956
STAPVGTTLYYYYGMDV

SEQ ID NO: 117913 - protein, 9 aa, Homo sapiens
  light chain complementarity determining region 3 for antibody 58957
QQYGSSPLT

SEQ ID NO: 117914 - protein, 12 aa, Homo sapiens
  heavy chain complementarity determining region 3 for antibody 58957
ARQQWLVPYFDC

SEQ ID NO: 117915 - protein, 9 aa, Homo sapiens
  light chain complementarity determining region 3 for antibody 58958
LQHNSYPLT

SEQ ID NO: 117916 - protein, 15 aa, Homo sapiens
  heavy chain complementarity determining region 3 for antibody 58958
ARGGFGEFYYYGMDV

SEQ ID NO: 117917 - protein, 9 aa, Homo sapiens
  light chain complementarity determining region 3 for antibody 58959
QQLNSYPRT

SEQ ID NO: 117918 - protein, 15 aa, Homo sapiens
  heavy chain complementarity determining region 3 for antibody 58959
ARDENYYNYYFGMDV

SEQ ID NO: 117919 - protein, 9 aa, Homo sapiens
  light chain complementarity determining region 3 for antibody 58960
HQTSSLPLT

SEQ ID NO: 117920 - protein, 9 aa, Homo sapiens
  heavy chain complementarity determining region 3 for antibody 58960
ARDISAADY

SEQ ID NO: 117921 - protein, 9 aa, Homo sapiens
  light chain complementarity determining region 3 for antibody 58961
QQLNSYPRT

SEQ ID NO: 117922 - protein, 15 aa, Homo sapiens
  heavy chain complementarity determining region 3 for antibody 58961
ARDENYYNYYYGMDV

SEQ ID NO: 117923 - protein, 9 aa, Homo sapiens
  light chain complementarity determining region 3 for antibody 58962
HQSSSLPWT

SEQ ID NO: 117924 - protein, 16 aa, Homo sapiens
  heavy chain complementarity determining region 3 for antibody 58962
ATDRYYYGSGSYPFDK

SEQ ID NO: 117925 - protein, 9 aa, Homo sapiens
  light chain complementarity determining region 3 for antibody 58963
QQLNSYPWT

SEQ ID NO: 117926 - protein, 14 aa, Homo sapiens
  heavy chain complementarity determining region 3 for antibody 58963
ARREIAVAGSSFDY

SEQ ID NO: 117927 - protein, 9 aa, Homo sapiens
  light chain complementarity determining region 3 for antibody 58964
LQDYNYPRT

SEQ ID NO: 117928 - protein, 11 aa, Homo sapiens
  heavy chain complementarity determining region 3 for antibody 58964
TRETLARGFDY

SEQ ID NO: 117929 - protein, 9 aa, Homo sapiens
  light chain complementarity determining region 3 for antibody 58965
LQDYNYPRT

SEQ ID NO: 117930 - protein, 11 aa, Homo sapiens
  heavy chain complementarity determining region 3 for antibody 58965
TRETLERGIDY

SEQ ID NO: 117931 - protein, 9 aa, Homo sapiens
  light chain complementarity determining region 3 for antibody 58966
LQDYNYPYT

SEQ ID NO: 117932 - protein, 13 aa, Homo sapiens
  heavy chain complementarity determining region 3 for antibody 58966
ARDRYFDWLSLDY

SEQ ID NO: 117933 - protein, 9 aa, Homo sapiens
  light chain complementarity determining region 3 for antibody 58967
LQDYNYPRT

SEQ ID NO: 117934 - protein, 11 aa, Homo sapiens
  heavy chain complementarity determining region 3 for antibody 58967
TRDTLERGFDY

SEQ ID NO: 117935 - protein, 9 aa, Homo sapiens
  light chain complementarity determining region 3 for antibody 58968
HQSSSLPHT

SEQ ID NO: 117936 - protein, 13 aa, Homo sapiens
  heavy chain complementarity determining region 3 for antibody 58968
ARGVYSSGWYFDY

SEQ ID NO: 117937 - protein, 9 aa, Homo sapiens
  light chain complementarity determining region 3 for antibody 58969
QQVNSFPWT

SEQ ID NO: 117938 - protein, 7 aa, Homo sapiens
  heavy chain complementarity determining region 3 for antibody 58969
ARDFFDY

SEQ ID NO: 117939 - protein, 9 aa, Homo sapiens
  light chain complementarity determining region 3 for antibody 58970
LQHNSYPYT

SEQ ID NO: 117940 - protein, 15 aa, Homo sapiens
  heavy chain complementarity determining region 3 for antibody 58970
AGERGLWFGLEGMDV

SEQ ID NO: 117941 - protein, 9 aa, Homo sapiens
  light chain complementarity determining region 3 for antibody 58971
QQYNSYPRT

SEQ ID NO: 117942 - protein, 17 aa, Homo sapiens
  heavy chain complementarity determining region 3 for antibody 58971
SAAPVGTTLYYYYGMDV

SEQ ID NO: 117943 - protein, 9 aa, Homo sapiens
  light chain complementarity determining region 3 for antibody 58972
QQYNSYPYT

SEQ ID NO: 117944 - protein, 13 aa, Homo sapiens
  heavy chain complementarity determining region 3 for antibody 58972
ASDYGDYVGAFDI

SEQ ID NO: 117945 - protein, 9 aa, Homo sapiens
  light chain complementarity determining region 3 for antibody 58973
LQHNNYPYT

SEQ ID NO: 117946 - protein, 12 aa, Homo sapiens
  heavy chain complementarity determining region 3 for antibody 58973
ARDVFLFFGESP

SEQ ID NO: 117947 - protein, 9 aa, Homo sapiens
  light chain complementarity determining region 3 for antibody 58974
QQYGSSPYT

SEQ ID NO: 117948 - protein, 19 aa, Homo sapiens
  heavy chain complementarity determining region 3 for antibody 58974
ARGDSLLWFGELLPDAFDI

SEQ ID NO: 117949 - protein, 9 aa, Homo sapiens
  light chain complementarity determining region 3 for antibody 58975
LQDYNYPRT

SEQ ID NO: 117950 - protein, 11 aa, Homo sapiens
  heavy chain complementarity determining region 3 for antibody 58975
TRETLERAFDY

SEQ ID NO: 117951 - protein, 9 aa, Homo sapiens
  light chain complementarity determining region 3 for antibody 58976
QQLNSYPLT

SEQ ID NO: 117952 - protein, 14 aa, Homo sapiens
  heavy chain complementarity determining region 3 for antibody 58976
ARGRSVLLWFGADY

SEQ ID NO: 117953 - protein, 9 aa, Homo sapiens
  light chain complementarity determining region 3 for antibody 58977
QQYDNLPYT

SEQ ID NO: 117954 - protein, 12 aa, Homo sapiens
  heavy chain complementarity determining region 3 for antibody 58977
ARAVAGYWSFDL

SEQ ID NO: 117955 - protein, 9 aa, Homo sapiens
  light chain complementarity determining region 3 for antibody 58978
QQLNTYPLT

SEQ ID NO: 117956 - protein, 9 aa, Homo sapiens
  heavy chain complementarity determining region 3 for antibody 58978
ARKKGTFDY

SEQ ID NO: 117957 - protein, 9 aa, Homo sapiens
  light chain complementarity determining region 3 for antibody 58979
QQYDNLPYT

SEQ ID NO: 117958 - protein, 9 aa, Homo sapiens
  heavy chain complementarity determining region 3 for antibody 58979
AKDGAVDQH

SEQ ID NO: 117959 - protein, 9 aa, Homo sapiens
  light chain complementarity determining region 3 for antibody 58980
QQYNSYPYT

SEQ ID NO: 117960 - protein, 15 aa, Homo sapiens
  heavy chain complementarity determining region 3 for antibody 58980
ASGRRFGESYYGMDV

SEQ ID NO: 117961 - protein, 9 aa, Homo sapiens
  light chain complementarity determining region 3 for antibody 58981
LQDYNYPWT

SEQ ID NO: 117962 - protein, 15 aa, Homo sapiens
  heavy chain complementarity determining region 3 for antibody 58981
AREFGSYSSGWYFDY

SEQ ID NO: 117963 - protein, 9 aa, Homo sapiens
  light chain complementarity determining region 3 for antibody 58982
LQDYNYPYT

SEQ ID NO: 117964 - protein, 17 aa, Homo sapiens
  heavy chain complementarity determining region 3 for antibody 58982
ARDLRYFDGFLSDAFDI

SEQ ID NO: 117965 - protein, 9 aa, Homo sapiens
  light chain complementarity determining region 3 for antibody 58983
LQDYNYPWT

SEQ ID NO: 117966 - protein, 21 aa, Homo sapiens
  heavy chain complementarity determining region 3 for antibody 58983
ARDGRDYGSGSHYYYYYGMDV

SEQ ID NO: 117967 - protein, 9 aa, Homo sapiens
  light chain complementarity determining region 3 for antibody 58984
QQDYNLPWT

SEQ ID NO: 117968 - protein, 16 aa, Homo sapiens
  heavy chain complementarity determining region 3 for antibody 58984
ARGYRSGWEFYYGMDV

SEQ ID NO: 117969 - protein, 9 aa, Homo sapiens
  light chain complementarity determining region 3 for antibody 58985
QQYNSYPRT

SEQ ID NO: 117970 - protein, 9 aa, Homo sapiens
  heavy chain complementarity determining region 3 for antibody 58985
ARDLSGSDY

SEQ ID NO: 117971 - protein, 9 aa, Homo sapiens
  light chain complementarity determining region 3 for antibody 58986
QQFNNYPYT

SEQ ID NO: 117972 - protein, 12 aa, Homo sapiens
  heavy chain complementarity determining region 3 for antibody 58986
ARVWRFGEFFDY

SEQ ID NO: 117973 - protein, 9 aa, Homo sapiens
  light chain complementarity determining region 3 for antibody 58987
QQLNSYPYT

SEQ ID NO: 117974 - protein, 19 aa, Homo sapiens
  heavy chain complementarity determining region 3 for antibody 58987
ARKGHYDSLTGYYPDAFDI

SEQ ID NO: 117975 - protein, 9 aa, Homo sapiens
  light chain complementarity determining region 3 for antibody 58988
QQYNSYPLT

SEQ ID NO: 117976 - protein, 14 aa, Homo sapiens
  heavy chain complementarity determining region 3 for antibody 58988
ARDRYGGNLNWFDP

SEQ ID NO: 117977 - protein, 9 aa, Homo sapiens
  light chain complementarity determining region 3 for antibody 58989
QQYNSYPRT

SEQ ID NO: 117978 - protein, 17 aa, Homo sapiens
  heavy chain complementarity determining region 3 for antibody 58989
ATAPVGTTLYYYYGMDV

SEQ ID NO: 117979 - protein, 10 aa, Homo sapiens
  light chain complementarity determining region 3 for antibody 58990
QQFNSYPPYT

SEQ ID NO: 117980 - protein, 14 aa, Homo sapiens
  heavy chain complementarity determining region 3 for antibody 58990
AGDGRLTMVRGGDF

SEQ ID NO: 117981 - protein, 9 aa, Homo sapiens
  light chain complementarity determining region 3 for antibody 58991
LQDYNYPRT

SEQ ID NO: 117982 - protein, 11 aa, Homo sapiens
  heavy chain complementarity determining region 3 for antibody 58991
TRETLERGFDS

SEQ ID NO: 117983 - protein, 9 aa, Homo sapiens
  light chain complementarity determining region 3 for antibody 58992
QQFNNYPYT

SEQ ID NO: 117984 - protein, 15 aa, Homo sapiens
  heavy chain complementarity determining region 3 for antibody 58992
AREGFGESFHWFFDL

SEQ ID NO: 117985 - protein, 9 aa, Homo sapiens
  light chain complementarity determining region 3 for antibody 58993
LQDYNYPRT

SEQ ID NO: 117986 - protein, 11 aa, Homo sapiens
  heavy chain complementarity determining region 3 for antibody 58993
TRETLERGFAY

SEQ ID NO: 117987 - protein, 9 aa, Homo sapiens
  light chain complementarity determining region 3 for antibody 58994
QQYNSYPRT

SEQ ID NO: 117988 - protein, 17 aa, Homo sapiens
  heavy chain complementarity determining region 3 for antibody 58994
STAPVGTTLSYYYGMDV

SEQ ID NO: 117989 - protein, 9 aa, Homo sapiens
  light chain complementarity determining region 3 for antibody 58995
QQYNSYPPT

SEQ ID NO: 117990 - protein, 12 aa, Homo sapiens
  heavy chain complementarity determining region 3 for antibody 58995
ARELEQQSVFDY

SEQ ID NO: 117991 - protein, 9 aa, Homo sapiens
  light chain complementarity determining region 3 for antibody 58996
RQLNSYPYT

SEQ ID NO: 117992 - protein, 19 aa, Homo sapiens
  heavy chain complementarity determining region 3 for antibody 58996
ARKGHYDILTGYYPDAFDI

SEQ ID NO: 117993 - protein, 9 aa, Homo sapiens
  light chain complementarity determining region 3 for antibody 58997
QQYDNLPYT

SEQ ID NO: 117994 - protein, 12 aa, Homo sapiens
  heavy chain complementarity determining region 3 for antibody 58997
ARAVAGSWYFDL

SEQ ID NO: 117995 - protein, 9 aa, Homo sapiens
  light chain complementarity determining region 3 for antibody 58998
LQDYNYPRT

SEQ ID NO: 117996 - protein, 11 aa, Homo sapiens
  heavy chain complementarity determining region 3 for antibody 58998
TRDTLDRGFDY

SEQ ID NO: 117997 - protein, 9 aa, Homo sapiens
  light chain complementarity determining region 3 for antibody 58999
LQDYNYPRT

SEQ ID NO: 117998 - protein, 11 aa, Homo sapiens
  heavy chain complementarity determining region 3 for antibody 58999
TRETLYRGFDY

SEQ ID NO: 117999 - protein, 9 aa, Homo sapiens
  light chain complementarity determining region 3 for antibody 59000
HQTSSLPLT

SEQ ID NO: 118000 - protein, 9 aa, Homo sapiens
  heavy chain complementarity determining region 3 for antibody 59000
ARDISADDY

SEQ ID NO: 118001 - protein, 9 aa, Homo sapiens
  light chain complementarity determining region 3 for antibody 59001
LQHNSYPPT

SEQ ID NO: 118002 - protein, 17 aa, Homo sapiens
  heavy chain complementarity determining region 3 for antibody 59001
AREGNDILTGYYHALDI

SEQ ID NO: 118003 - protein, 9 aa, Homo sapiens
  light chain complementarity determining region 3 for antibody 59002
HQTSSLPLT

SEQ ID NO: 118004 - protein, 9 aa, Homo sapiens
  heavy chain complementarity determining region 3 for antibody 59002
ARDISATDY

SEQ ID NO: 118005 - protein, 9 aa, Homo sapiens
  light chain complementarity determining region 3 for antibody 59003
LRDYNYPRT

SEQ ID NO: 118006 - protein, 11 aa, Homo sapiens
  heavy chain complementarity determining region 3 for antibody 59003
TRETLERGFDY

SEQ ID NO: 118007 - protein, 9 aa, Homo sapiens
  light chain complementarity determining region 3 for antibody 59004
LQDYNYPRA

SEQ ID NO: 118008 - protein, 11 aa, Homo sapiens
  heavy chain complementarity determining region 3 for antibody 59004
TRETLERGFDY

SEQ ID NO: 118009 - protein, 9 aa, Homo sapiens
  light chain complementarity determining region 3 for antibody 59005
IQDYNYPRT

SEQ ID NO: 118010 - protein, 11 aa, Homo sapiens
  heavy chain complementarity determining region 3 for antibody 59005
TRETLERGFDY

SEQ ID NO: 118011 - protein, 9 aa, Homo sapiens
  light chain complementarity determining region 3 for antibody 59006
LQHNSYPWT

SEQ ID NO: 118012 - protein, 17 aa, Homo sapiens
  heavy chain complementarity determining region 3 for antibody 59006
ARDCSGGTCYWGDAFDI

SEQ ID NO: 118013 - protein, 9 aa, Homo sapiens
  light chain complementarity determining region 3 for antibody 59007
QQYDNLPYT

SEQ ID NO: 118014 - protein, 12 aa, Homo sapiens
  heavy chain complementarity determining region 3 for antibody 59007
ARAVAGYWDFDL

SEQ ID NO: 118015 - protein, 9 aa, Homo sapiens
  light chain complementarity determining region 3 for antibody 59008
LQDYNYPRT

SEQ ID NO: 118016 - protein, 11 aa, Homo sapiens
  heavy chain complementarity determining region 3 for antibody 59008
TRETLDRGIDY

SEQ ID NO: 118017 - protein, 9 aa, Homo sapiens
  light chain complementarity determining region 3 for antibody 59009
QQYDNPPYT

SEQ ID NO: 118018 - protein, 12 aa, Homo sapiens
  heavy chain complementarity determining region 3 for antibody 59009
ARAVAGYWYFDL

SEQ ID NO: 118019 - protein, 9 aa, Homo sapiens
  light chain complementarity determining region 3 for antibody 59010
QQFNNYPHT

SEQ ID NO: 118020 - protein, 11 aa, Homo sapiens
  heavy chain complementarity determining region 3 for antibody 59010
ARDGYSYSFDY

SEQ ID NO: 118021 - protein, 9 aa, Homo sapiens
  light chain complementarity determining region 3 for antibody 59011
LQHNNYPYT

SEQ ID NO: 118022 - protein, 12 aa, Homo sapiens
  heavy chain complementarity determining region 3 for antibody 59011
ARDVFLFFGEFH

SEQ ID NO: 118023 - protein, 9 aa, Homo sapiens
  light chain complementarity determining region 3 for antibody 59012
QQLNSYPYT

SEQ ID NO: 118024 - protein, 19 aa, Homo sapiens
  heavy chain complementarity determining region 3 for antibody 59012
ARKGQYDILTGYYPDAFDI

SEQ ID NO: 118025 - protein, 9 aa, Homo sapiens
  light chain complementarity determining region 3 for antibody 59013
QQYNSYPPT

SEQ ID NO: 118026 - protein, 12 aa, Homo sapiens
  heavy chain complementarity determining region 3 for antibody 59013
ARELEHQLVFDY

SEQ ID NO: 118027 - protein, 9 aa, Homo sapiens
  light chain complementarity determining region 3 for antibody 59014
LQDYNYPRT

SEQ ID NO: 118028 - protein, 11 aa, Homo sapiens
  heavy chain complementarity determining region 3 for antibody 59014
TRETLDRAFDY

SEQ ID NO: 118029 - protein, 9 aa, Homo sapiens
  light chain complementarity determining region 3 for antibody 59015
LQDYDYPFT

SEQ ID NO: 118030 - protein, 14 aa, Homo sapiens
  heavy chain complementarity determining region 3 for antibody 59015
AREGLWFGENWFDP

SEQ ID NO: 118031 - protein, 9 aa, Homo sapiens
  light chain complementarity determining region 3 for antibody 59016
LQHNSYPPT

SEQ ID NO: 118032 - protein, 17 aa, Homo sapiens
  heavy chain complementarity determining region 3 for antibody 59016
AGEGNDILTGYYHAFDI

SEQ ID NO: 118033 - protein, 9 aa, Homo sapiens
  light chain complementarity determining region 3 for antibody 59017
LQDYNHPRT

SEQ ID NO: 118034 - protein, 11 aa, Homo sapiens
  heavy chain complementarity determining region 3 for antibody 59017
TRETLERGFDY

SEQ ID NO: 118035 - protein, 9 aa, Homo sapiens
  light chain complementarity determining region 3 for antibody 59018
QQYDNLSYT

SEQ ID NO: 118036 - protein, 9 aa, Homo sapiens
  heavy chain complementarity determining region 3 for antibody 59018
AKDGAVAQH

SEQ ID NO: 118037 - protein, 9 aa, Homo sapiens
  light chain complementarity determining region 3 for antibody 59019
QQLNSSPLT

SEQ ID NO: 118038 - protein, 11 aa, Homo sapiens
  heavy chain complementarity determining region 3 for antibody 59019
ARHGDYYGMDV

SEQ ID NO: 118039 - protein, 9 aa, Homo sapiens
  light chain complementarity determining region 3 for antibody 59020
LQDYNYPRT

SEQ ID NO: 118040 - protein, 13 aa, Homo sapiens
  heavy chain complementarity determining region 3 for antibody 59020
ALNYGDYGDWFDP

SEQ ID NO: 118041 - protein, 9 aa, Homo sapiens
  light chain complementarity determining region 3 for antibody 59021
QQYNSYPPT

SEQ ID NO: 118042 - protein, 12 aa, Homo sapiens
  heavy chain complementarity determining region 3 for antibody 59021
ARELEQQLAFDY

SEQ ID NO: 118043 - protein, 9 aa, Homo sapiens
  light chain complementarity determining region 3 for antibody 59022
QQYDNLPCT

SEQ ID NO: 118044 - protein, 12 aa, Homo sapiens
  heavy chain complementarity determining region 3 for antibody 59022
ARAVAGYWYFDL

SEQ ID NO: 118045 - protein, 9 aa, Homo sapiens
  light chain complementarity determining region 3 for antibody 59023
QQSYSTPST

SEQ ID NO: 118046 - protein, 12 aa, Homo sapiens
  heavy chain complementarity determining region 3 for antibody 59023
ARLGWELHDFDY

SEQ ID NO: 118047 - protein, 9 aa, Homo sapiens
  light chain complementarity determining region 3 for antibody 59024
QQDYNLPYT

SEQ ID NO: 118048 - protein, 9 aa, Homo sapiens
  heavy chain complementarity determining region 3 for antibody 59024
ARDRDFFDY

SEQ ID NO: 118049 - protein, 9 aa, Homo sapiens
  light chain complementarity determining region 3 for antibody 59025
LQHNNYPYT

SEQ ID NO: 118050 - protein, 12 aa, Homo sapiens
  heavy chain complementarity determining region 3 for antibody 59025
ARDVFLFFGEYP

SEQ ID NO: 118051 - protein, 9 aa, Homo sapiens
  light chain complementarity determining region 3 for antibody 59026
HQYHRSPLT

SEQ ID NO: 118052 - protein, 11 aa, Homo sapiens
  heavy chain complementarity determining region 3 for antibody 59026
ARTPYFPAFDY

SEQ ID NO: 118053 - protein, 9 aa, Homo sapiens
  light chain complementarity determining region 3 for antibody 59027
QQSYSTPFN

SEQ ID NO: 118054 - protein, 12 aa, Homo sapiens
  heavy chain complementarity determining region 3 for antibody 59027
ARLGWELHDFDY

SEQ ID NO: 118055 - protein, 9 aa, Homo sapiens
  light chain complementarity determining region 3 for antibody 59028
LQHNSYPPT

SEQ ID NO: 118056 - protein, 17 aa, Homo sapiens
  heavy chain complementarity determining region 3 for antibody 59028
AREGNDILTSYYHAFDI

SEQ ID NO: 118057 - protein, 9 aa, Homo sapiens
  light chain complementarity determining region 3 for antibody 59029
LQHNSYPPT

SEQ ID NO: 118058 - protein, 17 aa, Homo sapiens
  heavy chain complementarity determining region 3 for antibody 59029
AREGNDILAGYYHAFDI

SEQ ID NO: 118059 - protein, 9 aa, Homo sapiens
  light chain complementarity determining region 3 for antibody 59030
LQDYNYPRT

SEQ ID NO: 118060 - protein, 11 aa, Homo sapiens
  heavy chain complementarity determining region 3 for antibody 59030
TRETLEQGFDY

SEQ ID NO: 118061 - protein, 9 aa, Homo sapiens
  light chain complementarity determining region 3 for antibody 59031
LQDYNYPRT

SEQ ID NO: 118062 - protein, 11 aa, Homo sapiens
  heavy chain complementarity determining region 3 for antibody 59031
TREALERGFDY

SEQ ID NO: 118063 - protein, 9 aa, Homo sapiens
  light chain complementarity determining region 3 for antibody 59032
QQYDNLPYT

SEQ ID NO: 118064 - protein, 12 aa, Homo sapiens
  heavy chain complementarity determining region 3 for antibody 59032
ARAVAVYWYFDL

SEQ ID NO: 118065 - protein, 9 aa, Homo sapiens
  light chain complementarity determining region 3 for antibody 59033
LQDYNYPRT

SEQ ID NO: 118066 - protein, 11 aa, Homo sapiens
  heavy chain complementarity determining region 3 for antibody 59033
TSETLERGFDY

SEQ ID NO: 118067 - protein, 9 aa, Homo sapiens
  light chain complementarity determining region 3 for antibody 59034
LQDYNYPRT

SEQ ID NO: 118068 - protein, 11 aa, Homo sapiens
  heavy chain complementarity determining region 3 for antibody 59034
TRETLERGSDY

SEQ ID NO: 118069 - protein, 9 aa, Homo sapiens
  light chain complementarity determining region 3 for antibody 59035
QQLNSYPYT

SEQ ID NO: 118070 - protein, 19 aa, Homo sapiens
  heavy chain complementarity determining region 3 for antibody 59035
ARKGHYDILTGYFPDAFDI

SEQ ID NO: 118071 - protein, 9 aa, Homo sapiens
  light chain complementarity determining region 3 for antibody 59036
MQALQTPYT

SEQ ID NO: 118072 - protein, 18 aa, Homo sapiens
  heavy chain complementarity determining region 3 for antibody 59036
ARSLGGATYYYYYYGMDV

SEQ ID NO: 118073 - protein, 9 aa, Homo sapiens
  light chain complementarity determining region 3 for antibody 59037
QQLNSYPYT

SEQ ID NO: 118074 - protein, 19 aa, Homo sapiens
  heavy chain complementarity determining region 3 for antibody 59037
ARKGHYDILTGYSPDAFDI

SEQ ID NO: 118075 - protein, 9 aa, Homo sapiens
  light chain complementarity determining region 3 for antibody 59038
QQFNNYPYT

SEQ ID NO: 118076 - protein, 15 aa, Homo sapiens
  heavy chain complementarity determining region 3 for antibody 59038
AREGFGESLHWSFDL

SEQ ID NO: 118077 - protein, 9 aa, Homo sapiens
  light chain complementarity determining region 3 for antibody 59039
LQHNSYPPT

SEQ ID NO: 118078 - protein, 17 aa, Homo sapiens
  heavy chain complementarity determining region 3 for antibody 59039
AREGDDILTGYYHAFDI

SEQ ID NO: 118079 - protein, 9 aa, Homo sapiens
  light chain complementarity determining region 3 for antibody 59040
LQHNSYPFT

SEQ ID NO: 118080 - protein, 13 aa, Homo sapiens
  heavy chain complementarity determining region 3 for antibody 59040
ASDYGDYVGAFDI

SEQ ID NO: 118081 - protein, 9 aa, Homo sapiens
  light chain complementarity determining region 3 for antibody 59041
QQYNSYPRT

SEQ ID NO: 118082 - protein, 17 aa, Homo sapiens
  heavy chain complementarity determining region 3 for antibody 59041
SAAPVGTTLSYYYGMDV

SEQ ID NO: 118083 - protein, 9 aa, Homo sapiens
  light chain complementarity determining region 3 for antibody 59042
QQYNSYPPT

SEQ ID NO: 118084 - protein, 12 aa, Homo sapiens
  heavy chain complementarity determining region 3 for antibody 59042
ARELEQQLVIDY

SEQ ID NO: 118085 - protein, 9 aa, Homo sapiens
  light chain complementarity determining region 3 for antibody 59043
QQLSSYPRT

SEQ ID NO: 118086 - protein, 15 aa, Homo sapiens
  heavy chain complementarity determining region 3 for antibody 59043
ARDENYYNYYFGMDV

SEQ ID NO: 118087 - protein, 9 aa, Homo sapiens
  light chain complementarity determining region 3 for antibody 59044
QQYNSYSRT

SEQ ID NO: 118088 - protein, 17 aa, Homo sapiens
  heavy chain complementarity determining region 3 for antibody 59044
STAPVGTTLYYYYGMDV

SEQ ID NO: 118089 - protein, 9 aa, Homo sapiens
  light chain complementarity determining region 3 for antibody 59045
QQYGSSPYT

SEQ ID NO: 118090 - protein, 19 aa, Homo sapiens
  heavy chain complementarity determining region 3 for antibody 59045
ARGDSLLWFGELFPDAFDI

SEQ ID NO: 118091 - protein, 9 aa, Homo sapiens
  light chain complementarity determining region 3 for antibody 59046
LQHNSYPPT

SEQ ID NO: 118092 - protein, 17 aa, Homo sapiens
  heavy chain complementarity determining region 3 for antibody 59046
AREGNDILTGYYHAIDI

SEQ ID NO: 118093 - protein, 9 aa, Homo sapiens
  light chain complementarity determining region 3 for antibody 59047
LQDYNYPWT

SEQ ID NO: 118094 - protein, 21 aa, Homo sapiens
  heavy chain complementarity determining region 3 for antibody 59047
ARDGGDYGSGSHYYYYYGMDV

SEQ ID NO: 118095 - protein, 9 aa, Homo sapiens
  light chain complementarity determining region 3 for antibody 59048
QQYNSYPPT

SEQ ID NO: 118096 - protein, 12 aa, Homo sapiens
  heavy chain complementarity determining region 3 for antibody 59048
ARELAQQLVFDY

SEQ ID NO: 118097 - protein, 9 aa, Homo sapiens
  light chain complementarity determining region 3 for antibody 59049
QQFNSYPYT

SEQ ID NO: 118098 - protein, 19 aa, Homo sapiens
  heavy chain complementarity determining region 3 for antibody 59049
ARKGHYDILTGYYPDAFDI

SEQ ID NO: 118099 - protein, 9 aa, Homo sapiens
  light chain complementarity determining region 3 for antibody 59050
LQHNSYPLT

SEQ ID NO: 118100 - protein, 15 aa, Homo sapiens
  heavy chain complementarity determining region 3 for antibody 59050
ARGGFGEFYHYGMDV

SEQ ID NO: 118101 - protein, 9 aa, Homo sapiens
  light chain complementarity determining region 3 for antibody 59051
LQGYNYPRT

SEQ ID NO: 118102 - protein, 11 aa, Homo sapiens
  heavy chain complementarity determining region 3 for antibody 59051
TRETLERGFDY

SEQ ID NO: 118103 - protein, 9 aa, Homo sapiens
  light chain complementarity determining region 3 for antibody 59052
HQTSSLPLT

SEQ ID NO: 118104 - protein, 9 aa, Homo sapiens
  heavy chain complementarity determining region 3 for antibody 59052
ASDISAADY

SEQ ID NO: 118105 - protein, 9 aa, Homo sapiens
  light chain complementarity determining region 3 for antibody 59053
FQGSGYPLT

SEQ ID NO: 118106 - protein, 9 aa, Homo sapiens
  heavy chain complementarity determining region 3 for antibody 59053
ARGGLPIDY

SEQ ID NO: 118107 - protein, 9 aa, Homo sapiens
  light chain complementarity determining region 3 for antibody 59054
QQYNSYPPT

SEQ ID NO: 118108 - protein, 12 aa, Homo sapiens
  heavy chain complementarity determining region 3 for antibody 59054
AREVEQQLVFDY

SEQ ID NO: 118109 - protein, 9 aa, Homo sapiens
  light chain complementarity determining region 3 for antibody 59055
QQYDNLPYT

SEQ ID NO: 118110 - protein, 12 aa, Homo sapiens
  heavy chain complementarity determining region 3 for antibody 59055
ASAVAGYWYFDL

SEQ ID NO: 118111 - protein, 9 aa, Homo sapiens
  light chain complementarity determining region 3 for antibody 59056
QQFNNYPHT

SEQ ID NO: 118112 - protein, 11 aa, Homo sapiens
  heavy chain complementarity determining region 3 for antibody 59056
ARDGYSYYIDY

SEQ ID NO: 118113 - protein, 9 aa, Homo sapiens
  light chain complementarity determining region 3 for antibody 59057
LQSDNLPFT

SEQ ID NO: 118114 - protein, 11 aa, Homo sapiens
  heavy chain complementarity determining region 3 for antibody 59057
TRGGSYYATDY

SEQ ID NO: 118115 - protein, 9 aa, Homo sapiens
  light chain complementarity determining region 3 for antibody 59058
LQDYNYPRT

SEQ ID NO: 118116 - protein, 11 aa, Homo sapiens
  heavy chain complementarity determining region 3 for antibody 59058
TRETLERGFEY

SEQ ID NO: 118117 - protein, 9 aa, Homo sapiens
  light chain complementarity determining region 3 for antibody 59059
LQDYNYPWT

SEQ ID NO: 118118 - protein, 11 aa, Homo sapiens
  heavy chain complementarity determining region 3 for antibody 59059
AREGAPYGMDV

SEQ ID NO: 118119 - protein, 9 aa, Homo sapiens
  light chain complementarity determining region 3 for antibody 59060
HQSSSLPFT

SEQ ID NO: 118120 - protein, 11 aa, Homo sapiens
  heavy chain complementarity determining region 3 for antibody 59060
ARQGPNWDFDY

SEQ ID NO: 118121 - protein, 9 aa, Homo sapiens
  light chain complementarity determining region 3 for antibody 59061
QQYNSYPRT

SEQ ID NO: 118122 - protein, 17 aa, Homo sapiens
  heavy chain complementarity determining region 3 for antibody 59061
STAPVGTTLYYSYGMDV

SEQ ID NO: 118123 - protein, 9 aa, Homo sapiens
  light chain complementarity determining region 3 for antibody 59062
QQYKSYPYT

SEQ ID NO: 118124 - protein, 13 aa, Homo sapiens
  heavy chain complementarity determining region 3 for antibody 59062
ARERWEPGVYCEH

SEQ ID NO: 118125 - protein, 9 aa, Homo sapiens
  light chain complementarity determining region 3 for antibody 59063
QQYDNLPYT

SEQ ID NO: 118126 - protein, 12 aa, Homo sapiens
  heavy chain complementarity determining region 3 for antibody 59063
ARAVAGYWYIDL

SEQ ID NO: 118127 - protein, 9 aa, Homo sapiens
  light chain complementarity determining region 3 for antibody 59064
QQGNTLPWT

SEQ ID NO: 118128 - protein, 16 aa, Homo sapiens
  heavy chain complementarity determining region 3 for antibody 59064
VRSYYGSSLYYYAMDY

SEQ ID NO: 118129 - protein, 9 aa, Homo sapiens
  light chain complementarity determining region 3 for antibody 59065
LQHNSYPPT

SEQ ID NO: 118130 - protein, 17 aa, Homo sapiens
  heavy chain complementarity determining region 3 for antibody 59065
AREGNDILTGYYHAFDT

SEQ ID NO: 118131 - protein, 9 aa, Homo sapiens
  light chain complementarity determining region 3 for antibody 59066
LQDYNYPRT

SEQ ID NO: 118132 - protein, 11 aa, Homo sapiens
  heavy chain complementarity determining region 3 for antibody 59066
TRETLDRGFAY

SEQ ID NO: 118133 - protein, 9 aa, Homo sapiens
  light chain complementarity determining region 3 for antibody 59067
LQDYNYPWT

SEQ ID NO: 118134 - protein, 11 aa, Homo sapiens
  heavy chain complementarity determining region 3 for antibody 59067
ARDGAVAGADY

SEQ ID NO: 118135 - protein, 9 aa, Homo sapiens
  light chain complementarity determining region 3 for antibody 59068
HQSSSLPWT

SEQ ID NO: 118136 - protein, 16 aa, Homo sapiens
  heavy chain complementarity determining region 3 for antibody 59068
AADRYYYGSGSYPFDK

SEQ ID NO: 118137 - protein, 9 aa, Homo sapiens
  light chain complementarity determining region 3 for antibody 59069
QQFNNYPYA

SEQ ID NO: 118138 - protein, 15 aa, Homo sapiens
  heavy chain complementarity determining region 3 for antibody 59069
AREGFGESLHWFFDL

SEQ ID NO: 118139 - protein, 9 aa, Homo sapiens
  light chain complementarity determining region 3 for antibody 59070
LQDYNYPRT

SEQ ID NO: 118140 - protein, 11 aa, Homo sapiens
  heavy chain complementarity determining region 3 for antibody 59070
TRETRERGFDY

SEQ ID NO: 118141 - protein, 9 aa, Homo sapiens
  light chain complementarity determining region 3 for antibody 59071
LQDYNYPRT

SEQ ID NO: 118142 - protein, 11 aa, Homo sapiens
  heavy chain complementarity determining region 3 for antibody 59071
TRETLEPGFDY

SEQ ID NO: 118143 - protein, 9 aa, Homo sapiens
  light chain complementarity determining region 3 for antibody 59072
QQYNSYPPT

SEQ ID NO: 118144 - protein, 12 aa, Homo sapiens
  heavy chain complementarity determining region 3 for antibody 59072
ARELKQQLVFDY

SEQ ID NO: 118145 - protein, 9 aa, Homo sapiens
  light chain complementarity determining region 3 for antibody 59073
QQYGSSPIT

SEQ ID NO: 118146 - protein, 12 aa, Homo sapiens
  heavy chain complementarity determining region 3 for antibody 59073
ARQQWLVPYFDC

SEQ ID NO: 118147 - protein, 9 aa, Homo sapiens
  light chain complementarity determining region 3 for antibody 59074
QQLSSYPWT

SEQ ID NO: 118148 - protein, 14 aa, Homo sapiens
  heavy chain complementarity determining region 3 for antibody 59074
ARREIAVAGSSFDY

SEQ ID NO: 118149 - protein, 9 aa, Homo sapiens
  light chain complementarity determining region 3 for antibody 59075
LQDYNYPRT

SEQ ID NO: 118150 - protein, 11 aa, Homo sapiens
  heavy chain complementarity determining region 3 for antibody 59075
TRETPERGFDY

SEQ ID NO: 118151 - protein, 9 aa, Homo sapiens
  light chain complementarity determining region 3 for antibody 59076
FQGSGYPLT

SEQ ID NO: 118152 - protein, 6 aa, Homo sapiens
  heavy chain complementarity determining region 3 for antibody 59076
ATYFAY

SEQ ID NO: 118153 - protein, 9 aa, Homo sapiens
  light chain complementarity determining region 3 for antibody 59077
QQYDNLPYT

SEQ ID NO: 118154 - protein, 12 aa, Homo sapiens
  heavy chain complementarity determining region 3 for antibody 59077
ARAVAGYWYFDP

SEQ ID NO: 118155 - protein, 9 aa, Homo sapiens
  light chain complementarity determining region 3 for antibody 59078
QHFWSTPWT

SEQ ID NO: 118156 - protein, 8 aa, Homo sapiens
  heavy chain complementarity determining region 3 for antibody 59078
AKHEGTAY

SEQ ID NO: 118157 - protein, 9 aa, Homo sapiens
  light chain complementarity determining region 3 for antibody 59079
LQDYNYPRT

SEQ ID NO: 118158 - protein, 11 aa, Homo sapiens
  heavy chain complementarity determining region 3 for antibody 59079
TRETLEREFDY

SEQ ID NO: 118159 - protein, 9 aa, Homo sapiens
  light chain complementarity determining region 3 for antibody 59080
QQYNSYPRT

SEQ ID NO: 118160 - protein, 17 aa, Homo sapiens
  heavy chain complementarity determining region 3 for antibody 59080
AAAPVGTTLYYYYGMDV

SEQ ID NO: 118161 - protein, 9 aa, Homo sapiens
  light chain complementarity determining region 3 for antibody 59081
LRDYIYPWT

SEQ ID NO: 118162 - protein, 11 aa, Homo sapiens
  heavy chain complementarity determining region 3 for antibody 59081
ARDGAVAGLDY

SEQ ID NO: 118163 - protein, 9 aa, Homo sapiens
  light chain complementarity determining region 3 for antibody 59082
LQHNSYPLT

SEQ ID NO: 118164 - protein, 15 aa, Homo sapiens
  heavy chain complementarity determining region 3 for antibody 59082
ARGGFGESYYYGMDV

SEQ ID NO: 118165 - protein, 9 aa, Homo sapiens
  light chain complementarity determining region 3 for antibody 59083
LQDYNYPYT

SEQ ID NO: 118166 - protein, 14 aa, Homo sapiens
  heavy chain complementarity determining region 3 for antibody 59083
ARDPYSGTSYGMDV

SEQ ID NO: 118167 - protein, 9 aa, Homo sapiens
  light chain complementarity determining region 3 for antibody 59084
QQYNSYPYT

SEQ ID NO: 118168 - protein, 20 aa, Homo sapiens
  heavy chain complementarity determining region 3 for antibody 59084
AREGVAAVGRVYSFYYGMDV

SEQ ID NO: 118169 - protein, 9 aa, Homo sapiens
  light chain complementarity determining region 3 for antibody 59085
QQYHSYPLT

SEQ ID NO: 118170 - protein, 13 aa, Homo sapiens
  heavy chain complementarity determining region 3 for antibody 59085
ARHYYGSIYAMDY

SEQ ID NO: 118171 - protein, 9 aa, Homo sapiens
  light chain complementarity determining region 3 for antibody 59086
QQYDNLPYT

SEQ ID NO: 118172 - protein, 12 aa, Homo sapiens
  heavy chain complementarity determining region 3 for antibody 59086
ARAVAGYWYFEL

SEQ ID NO: 118173 - protein, 9 aa, Homo sapiens
  light chain complementarity determining region 3 for antibody 59087
LQDYNYPRT

SEQ ID NO: 118174 - protein, 11 aa, Homo sapiens
  heavy chain complementarity determining region 3 for antibody 59087
TRETVERGFDY

SEQ ID NO: 118175 - protein, 9 aa, Homo sapiens
  light chain complementarity determining region 3 for antibody 59088
LQDYNYPRT

SEQ ID NO: 118176 - protein, 11 aa, Homo sapiens
  heavy chain complementarity determining region 3 for antibody 59088
TRETLERGLDY

SEQ ID NO: 118177 - protein, 9 aa, Homo sapiens
  light chain complementarity determining region 3 for antibody 59089
QQYNSFPRT

SEQ ID NO: 118178 - protein, 10 aa, Homo sapiens
  heavy chain complementarity determining region 3 for antibody 59089
ARGRLIGDNN

SEQ ID NO: 118179 - protein, 9 aa, Homo sapiens
  light chain complementarity determining region 3 for antibody 59090
QQYDNLPYT

SEQ ID NO: 118180 - protein, 12 aa, Homo sapiens
  heavy chain complementarity determining region 3 for antibody 59090
ARGVAGYWYFDL

SEQ ID NO: 118181 - protein, 9 aa, Homo sapiens
  light chain complementarity determining region 3 for antibody 59091
QQYDNLPYT

SEQ ID NO: 118182 - protein, 9 aa, Homo sapiens
  heavy chain complementarity determining region 3 for antibody 59091
AKDGAVAHH

SEQ ID NO: 118183 - protein, 9 aa, Homo sapiens
  light chain complementarity determining region 3 for antibody 59092
QQLNSYPYT

SEQ ID NO: 118184 - protein, 19 aa, Homo sapiens
  heavy chain complementarity determining region 3 for antibody 59092
ARKGHYDILTGYYPDAFGI

SEQ ID NO: 118185 - protein, 9 aa, Homo sapiens
  light chain complementarity determining region 3 for antibody 59093
QQFNNYPYT

SEQ ID NO: 118186 - protein, 15 aa, Homo sapiens
  heavy chain complementarity determining region 3 for antibody 59093
AREGFGESLPWFFDL

SEQ ID NO: 118187 - protein, 9 aa, Homo sapiens
  light chain complementarity determining region 3 for antibody 59094
LQHNSYPYT

SEQ ID NO: 118188 - protein, 15 aa, Homo sapiens
  heavy chain complementarity determining region 3 for antibody 59094
AGERGLWSGLEGMDV

SEQ ID NO: 118189 - protein, 9 aa, Homo sapiens
  light chain complementarity determining region 3 for antibody 59095
QRFNNYPYT

SEQ ID NO: 118190 - protein, 12 aa, Homo sapiens
  heavy chain complementarity determining region 3 for antibody 59095
ARVWRFGEFFDY

SEQ ID NO: 118191 - protein, 9 aa, Homo sapiens
  light chain complementarity determining region 3 for antibody 59096
QQYDNLPYT

SEQ ID NO: 118192 - protein, 9 aa, Homo sapiens
  heavy chain complementarity determining region 3 for antibody 59096
AKDGAVTQH

SEQ ID NO: 118193 - protein, 9 aa, Homo sapiens
  light chain complementarity determining region 3 for antibody 59097
QQPNSYPRT

SEQ ID NO: 118194 - protein, 15 aa, Homo sapiens
  heavy chain complementarity determining region 3 for antibody 59097
ARDENYYNYYFGMDV

SEQ ID NO: 118195 - protein, 9 aa, Homo sapiens
  light chain complementarity determining region 3 for antibody 59098
QQLNSYPRT

SEQ ID NO: 118196 - protein, 15 aa, Homo sapiens
  heavy chain complementarity determining region 3 for antibody 59098
ARDENYYNYYCGMDV

SEQ ID NO: 118197 - protein, 10 aa, Homo sapiens
  light chain complementarity determining region 3 for antibody 59099
PQFNSYPPYT

SEQ ID NO: 118198 - protein, 14 aa, Homo sapiens
  heavy chain complementarity determining region 3 for antibody 59099
ARDGRLTMVRGGDF

SEQ ID NO: 118199 - protein, 9 aa, Homo sapiens
  light chain complementarity determining region 3 for antibody 59100
LQDYNYPRT

SEQ ID NO: 118200 - protein, 11 aa, Homo sapiens
  heavy chain complementarity determining region 3 for antibody 59100
ARETLERGFDY

SEQ ID NO: 118201 - protein, 9 aa, Homo sapiens
  light chain complementarity determining region 3 for antibody 59101
HQTSSLPLT

SEQ ID NO: 118202 - protein, 9 aa, Homo sapiens
  heavy chain complementarity determining region 3 for antibody 59101
ARDTSAADY

SEQ ID NO: 118203 - protein, 9 aa, Homo sapiens
  light chain complementarity determining region 3 for antibody 59102
QQYNSYPRT

SEQ ID NO: 118204 - protein, 17 aa, Homo sapiens
  heavy chain complementarity determining region 3 for antibody 59102
SAAPVGTTLYYSYGMDV

SEQ ID NO: 118205 - protein, 9 aa, Homo sapiens
  light chain complementarity determining region 3 for antibody 59103
QQDHKLPYT

SEQ ID NO: 118206 - protein, 10 aa, Homo sapiens
  heavy chain complementarity determining region 3 for antibody 59103
ARADYYAMDV

SEQ ID NO: 118207 - protein, 9 aa, Homo sapiens
  light chain complementarity determining region 3 for antibody 59104
LQRNSYPPT

SEQ ID NO: 118208 - protein, 17 aa, Homo sapiens
  heavy chain complementarity determining region 3 for antibody 59104
AREGNDILTGYYHAFDI

SEQ ID NO: 118209 - protein, 9 aa, Homo sapiens
  light chain complementarity determining region 3 for antibody 59105
LQHNSYPPT

SEQ ID NO: 118210 - protein, 17 aa, Homo sapiens
  heavy chain complementarity determining region 3 for antibody 59105
AREGNDILTGYYHAFDF

SEQ ID NO: 118211 - protein, 9 aa, Homo sapiens
  light chain complementarity determining region 3 for antibody 59106
LQDYDYPRT

SEQ ID NO: 118212 - protein, 11 aa, Homo sapiens
  heavy chain complementarity determining region 3 for antibody 59106
TRETLERGFDY

SEQ ID NO: 118213 - protein, 9 aa, Homo sapiens
  light chain complementarity determining region 3 for antibody 59107
QQYVNLPYT

SEQ ID NO: 118214 - protein, 12 aa, Homo sapiens
  heavy chain complementarity determining region 3 for antibody 59107
ARAVAGYWYFDL

SEQ ID NO: 118215 - protein, 9 aa, Homo sapiens
  light chain complementarity determining region 3 for antibody 59108
QQYNSYPRT

SEQ ID NO: 118216 - protein, 17 aa, Homo sapiens
  heavy chain complementarity determining region 3 for antibody 59108
STAPVGTNLYYYYGMDV

SEQ ID NO: 118217 - protein, 9 aa, Homo sapiens
  light chain complementarity determining region 3 for antibody 59109
QQLNSYPYT

SEQ ID NO: 118218 - protein, 13 aa, Homo sapiens
  heavy chain complementarity determining region 3 for antibody 59109
ARDQDYGSGSPDY

SEQ ID NO: 118219 - protein, 9 aa, Homo sapiens
  light chain complementarity determining region 3 for antibody 59110
LQHNSYPPT

SEQ ID NO: 118220 - protein, 17 aa, Homo sapiens
  heavy chain complementarity determining region 3 for antibody 59110
AREGNDILTGYYQAFDI

SEQ ID NO: 118221 - protein, 9 aa, Homo sapiens
  light chain complementarity determining region 3 for antibody 59111
LQDYNYPWT

SEQ ID NO: 118222 - protein, 11 aa, Homo sapiens
  heavy chain complementarity determining region 3 for antibody 59111
AREGALYDMDV

SEQ ID NO: 118223 - protein, 9 aa, Homo sapiens
  light chain complementarity determining region 3 for antibody 59112
LQDYNYPRT

SEQ ID NO: 118224 - protein, 11 aa, Homo sapiens
  heavy chain complementarity determining region 3 for antibody 59112
TRETLDRGFDS

SEQ ID NO: 118225 - protein, 9 aa, Homo sapiens
  light chain complementarity determining region 3 for antibody 59113
LQDYNYPRT

SEQ ID NO: 118226 - protein, 11 aa, Homo sapiens
  heavy chain complementarity determining region 3 for antibody 59113
TGETLERGFDY

SEQ ID NO: 118227 - protein, 9 aa, Homo sapiens
  light chain complementarity determining region 3 for antibody 59114
IQDYIYPWT

SEQ ID NO: 118228 - protein, 11 aa, Homo sapiens
  heavy chain complementarity determining region 3 for antibody 59114
ARDGAVAGLDY

SEQ ID NO: 118229 - protein, 9 aa, Homo sapiens
  light chain complementarity determining region 3 for antibody 59115
QQYNSYPRT

SEQ ID NO: 118230 - protein, 17 aa, Homo sapiens
  heavy chain complementarity determining region 3 for antibody 59115
STAPVGTTLSYSYGMDV

SEQ ID NO: 118231 - protein, 9 aa, Homo sapiens
  light chain complementarity determining region 3 for antibody 59116
QQYNSYPPT

SEQ ID NO: 118232 - protein, 12 aa, Homo sapiens
  heavy chain complementarity determining region 3 for antibody 59116
ARELEQQLVFDH

SEQ ID NO: 118233 - protein, 8 aa, Homo sapiens
  light chain complementarity determining region 3 for antibody 59117
QQHYSIPT

SEQ ID NO: 118234 - protein, 8 aa, Homo sapiens
  heavy chain complementarity determining region 3 for antibody 59117
AKHEGTAY

SEQ ID NO: 118235 - protein, 9 aa, Homo sapiens
  light chain complementarity determining region 3 for antibody 59118
LQHNSYPPT

SEQ ID NO: 118236 - protein, 17 aa, Homo sapiens
  heavy chain complementarity determining region 3 for antibody 59118
ARGGNDILTGYYHAFDI

SEQ ID NO: 118237 - protein, 9 aa, Homo sapiens
  light chain complementarity determining region 3 for antibody 59119
LQHNSYPPT

SEQ ID NO: 118238 - protein, 17 aa, Homo sapiens
  heavy chain complementarity determining region 3 for antibody 59119
AREGNDSLTGYYHAFDI

SEQ ID NO: 118239 - protein, 9 aa, Homo sapiens
  light chain complementarity determining region 3 for antibody 59120
LQDYNYPRT

SEQ ID NO: 118240 - protein, 11 aa, Homo sapiens
  heavy chain complementarity determining region 3 for antibody 59120
TIETLERGFDY

SEQ ID NO: 118241 - protein, 9 aa, Homo sapiens
  light chain complementarity determining region 3 for antibody 59121
LQDYIYPWT

SEQ ID NO: 118242 - protein, 11 aa, Homo sapiens
  heavy chain complementarity determining region 3 for antibody 59121
ARDGAAAGLDY

SEQ ID NO: 118243 - protein, 9 aa, Homo sapiens
  light chain complementarity determining region 3 for antibody 59122
QQYKSCPYT

SEQ ID NO: 118244 - protein, 13 aa, Homo sapiens
  heavy chain complementarity determining region 3 for antibody 59122
ARERWEPGVYCEY

SEQ ID NO: 118245 - protein, 9 aa, Homo sapiens
  light chain complementarity determining region 3 for antibody 59123
QQYDNLPYT

SEQ ID NO: 118246 - protein, 12 aa, Homo sapiens
  heavy chain complementarity determining region 3 for antibody 59123
ARVVAGYWYFDL

SEQ ID NO: 118247 - protein, 9 aa, Homo sapiens
  light chain complementarity determining region 3 for antibody 59124
QQLNSYPYT

SEQ ID NO: 118248 - protein, 19 aa, Homo sapiens
  heavy chain complementarity determining region 3 for antibody 59124
ARKGHYDMLTGYYPDAFDI

SEQ ID NO: 118249 - protein, 9 aa, Homo sapiens
  light chain complementarity determining region 3 for antibody 59125
QQLNSYPYT

SEQ ID NO: 118250 - protein, 19 aa, Homo sapiens
  heavy chain complementarity determining region 3 for antibody 59125
ARKGHYDIVTGYYPDAFDI

SEQ ID NO: 118251 - protein, 9 aa, Homo sapiens
  light chain complementarity determining region 3 for antibody 59126
LQHNSYPYT

SEQ ID NO: 118252 - protein, 12 aa, Homo sapiens
  heavy chain complementarity determining region 3 for antibody 59126
ARDVFLFFGEFP

SEQ ID NO: 118253 - protein, 9 aa, Homo sapiens
  light chain complementarity determining region 3 for antibody 59127
LQHNSYPPT

SEQ ID NO: 118254 - protein, 17 aa, Homo sapiens
  heavy chain complementarity determining region 3 for antibody 59127
AREGNDILTGYYYAFDI

SEQ ID NO: 118255 - protein, 9 aa, Homo sapiens
  light chain complementarity determining region 3 for antibody 59128
LQHNNYPYT

SEQ ID NO: 118256 - protein, 12 aa, Homo sapiens
  heavy chain complementarity determining region 3 for antibody 59128
ARDVFLFFGEVP

SEQ ID NO: 118257 - protein, 9 aa, Homo sapiens
  light chain complementarity determining region 3 for antibody 59129
LQDYNYPRT

SEQ ID NO: 118258 - protein, 11 aa, Homo sapiens
  heavy chain complementarity determining region 3 for antibody 59129
TREPLERGFDY

SEQ ID NO: 118259 - protein, 9 aa, Homo sapiens
  light chain complementarity determining region 3 for antibody 59130
QQYKSYPYT

SEQ ID NO: 118260 - protein, 13 aa, Homo sapiens
  heavy chain complementarity determining region 3 for antibody 59130
ARERWEPGVYCDY

SEQ ID NO: 118261 - protein, 9 aa, Homo sapiens
  light chain complementarity determining region 3 for antibody 59131
QQYDSYPYT

SEQ ID NO: 118262 - protein, 15 aa, Homo sapiens
  heavy chain complementarity determining region 3 for antibody 59131
ASGRRFGESYYGMDV

SEQ ID NO: 118263 - protein, 9 aa, Homo sapiens
  light chain complementarity determining region 3 for antibody 59132
QQLNSYPYT

SEQ ID NO: 118264 - protein, 19 aa, Homo sapiens
  heavy chain complementarity determining region 3 for antibody 59132
AREGHYDILTGYYPDAFDI

SEQ ID NO: 118265 - protein, 9 aa, Homo sapiens
  light chain complementarity determining region 3 for antibody 59133
LQDYNYPRT

SEQ ID NO: 118266 - protein, 11 aa, Homo sapiens
  heavy chain complementarity determining region 3 for antibody 59133
TRETLERGFDD

SEQ ID NO: 118267 - protein, 9 aa, Homo sapiens
  light chain complementarity determining region 3 for antibody 59134
QQYNSYPPT

SEQ ID NO: 118268 - protein, 12 aa, Homo sapiens
  heavy chain complementarity determining region 3 for antibody 59134
ATELEQQLVFDY

SEQ ID NO: 118269 - protein, 9 aa, Homo sapiens
  light chain complementarity determining region 3 for antibody 59135
QQYNSYPPT

SEQ ID NO: 118270 - protein, 12 aa, Homo sapiens
  heavy chain complementarity determining region 3 for antibody 59135
ASELEQQLVFDY

SEQ ID NO: 118271 - protein, 9 aa, Homo sapiens
  light chain complementarity determining region 3 for antibody 59136
QQLNSYPLT

SEQ ID NO: 118272 - protein, 14 aa, Homo sapiens
  heavy chain complementarity determining region 3 for antibody 59136
ARGRSVFLWFGADY

SEQ ID NO: 118273 - protein, 10 aa, Homo sapiens
  light chain complementarity determining region 3 for antibody 59137
QQFNSYPPYT

SEQ ID NO: 118274 - protein, 14 aa, Homo sapiens
  heavy chain complementarity determining region 3 for antibody 59137
ARDGRLTMVRGRDF

SEQ ID NO: 118275 - protein, 9 aa, Homo sapiens
  light chain complementarity determining region 3 for antibody 59138
QQFNNYPHT

SEQ ID NO: 118276 - protein, 11 aa, Homo sapiens
  heavy chain complementarity determining region 3 for antibody 59138
ARDGYSYDFDY

SEQ ID NO: 118277 - protein, 9 aa, Homo sapiens
  light chain complementarity determining region 3 for antibody 59139
LQHNSYPPT

SEQ ID NO: 118278 - protein, 17 aa, Homo sapiens
  heavy chain complementarity determining region 3 for antibody 59139
AREGNDILIGYYHAFDI

SEQ ID NO: 118279 - protein, 9 aa, Homo sapiens
  light chain complementarity determining region 3 for antibody 59140
LQHNSYPLT

SEQ ID NO: 118280 - protein, 15 aa, Homo sapiens
  heavy chain complementarity determining region 3 for antibody 59140
ARGGFGECYYYGMDV

SEQ ID NO: 118281 - protein, 9 aa, Homo sapiens
  light chain complementarity determining region 3 for antibody 59141
LQHNNYPYT

SEQ ID NO: 118282 - protein, 12 aa, Homo sapiens
  heavy chain complementarity determining region 3 for antibody 59141
ARDVSLFFGEFP

SEQ ID NO: 118283 - protein, 9 aa, Homo sapiens
  light chain complementarity determining region 3 for antibody 59142
LQDYNYPRT

SEQ ID NO: 118284 - protein, 11 aa, Homo sapiens
  heavy chain complementarity determining region 3 for antibody 59142
TRETLDPGFDY

SEQ ID NO: 118285 - protein, 9 aa, Homo sapiens
  light chain complementarity determining region 3 for antibody 59143
LQDYNYPRT

SEQ ID NO: 118286 - protein, 11 aa, Homo sapiens
  heavy chain complementarity determining region 3 for antibody 59143
TRDTLARGFDY

SEQ ID NO: 118287 - protein, 9 aa, Homo sapiens
  light chain complementarity determining region 3 for antibody 59144
QQYNSYPRT

SEQ ID NO: 118288 - protein, 17 aa, Homo sapiens
  heavy chain complementarity determining region 3 for antibody 59144
STAPVGTTLYFYYGMDV

SEQ ID NO: 118289 - protein, 9 aa, Homo sapiens
  light chain complementarity determining region 3 for antibody 59145
QQYNSYPPT

SEQ ID NO: 118290 - protein, 12 aa, Homo sapiens
  heavy chain complementarity determining region 3 for antibody 59145
ARELGQQLVFDY

SEQ ID NO: 118291 - protein, 9 aa, Homo sapiens
  light chain complementarity determining region 3 for antibody 59146
QQLNSYPYT

SEQ ID NO: 118292 - protein, 19 aa, Homo sapiens
  heavy chain complementarity determining region 3 for antibody 59146
ARKGHCDILTGYYPDAFDI

SEQ ID NO: 118293 - protein, 9 aa, Homo sapiens
  light chain complementarity determining region 3 for antibody 59147
QQLNSYPYT

SEQ ID NO: 118294 - protein, 19 aa, Homo sapiens
  heavy chain complementarity determining region 3 for antibody 59147
ARKGDYDILTGYYPDAFDI

SEQ ID NO: 118295 - protein, 9 aa, Homo sapiens
  light chain complementarity determining region 3 for antibody 59148
QQFNNYPHT

SEQ ID NO: 118296 - protein, 11 aa, Homo sapiens
  heavy chain complementarity determining region 3 for antibody 59148
ARDGYSSYFDY

SEQ ID NO: 118297 - protein, 9 aa, Homo sapiens
  light chain complementarity determining region 3 for antibody 59149
LQHNSYPPT

SEQ ID NO: 118298 - protein, 17 aa, Homo sapiens
  heavy chain complementarity determining region 3 for antibody 59149
AREGNDIWTGYYHAFDI

SEQ ID NO: 118299 - protein, 9 aa, Homo sapiens
  light chain complementarity determining region 3 for antibody 59150
QQYNSYPRT

SEQ ID NO: 118300 - protein, 17 aa, Homo sapiens
  heavy chain complementarity determining region 3 for antibody 59150
ATAPVGTTLSYYYGMDV

SEQ ID NO: 118301 - protein, 9 aa, Homo sapiens
  light chain complementarity determining region 3 for antibody 59151
QQYNSYPRT

SEQ ID NO: 118302 - protein, 17 aa, Homo sapiens
  heavy chain complementarity determining region 3 for antibody 59151
AAAPVGTTLSYYYGMDV

SEQ ID NO: 118303 - protein, 9 aa, Homo sapiens
  light chain complementarity determining region 3 for antibody 59152
QQYNSYPPT

SEQ ID NO: 118304 - protein, 12 aa, Homo sapiens
  heavy chain complementarity determining region 3 for antibody 59152
ARELEQQWVFDY

SEQ ID NO: 118305 - protein, 9 aa, Homo sapiens
  light chain complementarity determining region 3 for antibody 59153
QQYNSYPPT

SEQ ID NO: 118306 - protein, 12 aa, Homo sapiens
  heavy chain complementarity determining region 3 for antibody 59153
ARELEQQLVFAY

SEQ ID NO: 118307 - protein, 9 aa, Homo sapiens
  light chain complementarity determining region 3 for antibody 59154
QQYDNLPYT

SEQ ID NO: 118308 - protein, 9 aa, Homo sapiens
  heavy chain complementarity determining region 3 for antibody 59154
AKDGAAAQH

SEQ ID NO: 118309 - protein, 9 aa, Homo sapiens
  light chain complementarity determining region 3 for antibody 59155
QQLNSYPYT

SEQ ID NO: 118310 - protein, 19 aa, Homo sapiens
  heavy chain complementarity determining region 3 for antibody 59155
ARKGHYDVLTGYYPDAFDI

SEQ ID NO: 118311 - protein, 9 aa, Homo sapiens
  light chain complementarity determining region 3 for antibody 59156
QQLNSYPLT

SEQ ID NO: 118312 - protein, 9 aa, Homo sapiens
  heavy chain complementarity determining region 3 for antibody 59156
ARKKGTFDY

SEQ ID NO: 118313 - protein, 9 aa, Homo sapiens
  light chain complementarity determining region 3 for antibody 59157
QQLNSYPLT

SEQ ID NO: 118314 - protein, 14 aa, Homo sapiens
  heavy chain complementarity determining region 3 for antibody 59157
ARGRSVLLWSGADY

SEQ ID NO: 118315 - protein, 9 aa, Homo sapiens
  light chain complementarity determining region 3 for antibody 59158
LQHNSYPPT

SEQ ID NO: 118316 - protein, 17 aa, Homo sapiens
  heavy chain complementarity determining region 3 for antibody 59158
AREGNDILPGYYHAFDI

SEQ ID NO: 118317 - protein, 9 aa, Homo sapiens
  light chain complementarity determining region 3 for antibody 59159
LQHNNYPYT

SEQ ID NO: 118318 - protein, 12 aa, Homo sapiens
  heavy chain complementarity determining region 3 for antibody 59159
ARDVFLFCGEFP

SEQ ID NO: 118319 - protein, 9 aa, Homo sapiens
  light chain complementarity determining region 3 for antibody 59160
LQDYIYPWT

SEQ ID NO: 118320 - protein, 11 aa, Homo sapiens
  heavy chain complementarity determining region 3 for antibody 59160
ARDGAVAGIDY

SEQ ID NO: 118321 - protein, 9 aa, Homo sapiens
  light chain complementarity determining region 3 for antibody 59161
QQYDNLPYT

SEQ ID NO: 118322 - protein, 12 aa, Homo sapiens
  heavy chain complementarity determining region 3 for antibody 59161
ARAVAGYWCFDL

SEQ ID NO: 118323 - protein, 9 aa, Homo sapiens
  light chain complementarity determining region 3 for antibody 59162
QQLNSYPYT

SEQ ID NO: 118324 - protein, 19 aa, Homo sapiens
  heavy chain complementarity determining region 3 for antibody 59162
ARKGHYDILTGYCPDAFDI

SEQ ID NO: 118325 - protein, 9 aa, Homo sapiens
  light chain complementarity determining region 3 for antibody 59163
LRHNSYPPT

SEQ ID NO: 118326 - protein, 17 aa, Homo sapiens
  heavy chain complementarity determining region 3 for antibody 59163
AREGNDILTGYYHAFDI

SEQ ID NO: 118327 - protein, 9 aa, Homo sapiens
  light chain complementarity determining region 3 for antibody 59164
LQHNSYPPT

SEQ ID NO: 118328 - protein, 17 aa, Homo sapiens
  heavy chain complementarity determining region 3 for antibody 59164
AREGNDILSGYYHAFDI

SEQ ID NO: 118329 - protein, 9 aa, Homo sapiens
  light chain complementarity determining region 3 for antibody 59165
LQDYNYPWT

SEQ ID NO: 118330 - protein, 21 aa, Homo sapiens
  heavy chain complementarity determining region 3 for antibody 59165
ARDGRDYGSGSHYSYYYGMDV

SEQ ID NO: 118331 - protein, 9 aa, Homo sapiens
  light chain complementarity determining region 3 for antibody 59166
LQDYNYPRT

SEQ ID NO: 118332 - protein, 11 aa, Homo sapiens
  heavy chain complementarity determining region 3 for antibody 59166
TRETLSRGFDY

SEQ ID NO: 118333 - protein, 9 aa, Homo sapiens
  light chain complementarity determining region 3 for antibody 59167
LQDYNYPRT

SEQ ID NO: 118334 - protein, 11 aa, Homo sapiens
  heavy chain complementarity determining region 3 for antibody 59167
TRETLERGYDY

SEQ ID NO: 118335 - protein, 9 aa, Homo sapiens
  light chain complementarity determining region 3 for antibody 59168
LQDYNYPRT

SEQ ID NO: 118336 - protein, 11 aa, Homo sapiens
  heavy chain complementarity determining region 3 for antibody 59168
TRETLERGCDY

SEQ ID NO: 118337 - protein, 9 aa, Homo sapiens
  light chain complementarity determining region 3 for antibody 59169
LQDYNYPQT

SEQ ID NO: 118338 - protein, 11 aa, Homo sapiens
  heavy chain complementarity determining region 3 for antibody 59169
TRETLERGFDY

SEQ ID NO: 118339 - protein, 9 aa, Homo sapiens
  light chain complementarity determining region 3 for antibody 59170
HQTSSLPLT

SEQ ID NO: 118340 - protein, 9 aa, Homo sapiens
  heavy chain complementarity determining region 3 for antibody 59170
ARDISANDY

SEQ ID NO: 118341 - protein, 9 aa, Homo sapiens
  light chain complementarity determining region 3 for antibody 59171
QQYNSYPYT

SEQ ID NO: 118342 - protein, 20 aa, Homo sapiens
  heavy chain complementarity determining region 3 for antibody 59171
AGEGVAAVGRVYYFYYGMDV

SEQ ID NO: 118343 - protein, 9 aa, Homo sapiens
  light chain complementarity determining region 3 for antibody 59172
QQYNSYPPT

SEQ ID NO: 118344 - protein, 12 aa, Homo sapiens
  heavy chain complementarity determining region 3 for antibody 59172
ARELEQQLVFDS

SEQ ID NO: 118345 - protein, 9 aa, Homo sapiens
  light chain complementarity determining region 3 for antibody 59173
QQYNSYPPT

SEQ ID NO: 118346 - protein, 12 aa, Homo sapiens
  heavy chain complementarity determining region 3 for antibody 59173
ARELEQPLVFDY

SEQ ID NO: 118347 - protein, 9 aa, Homo sapiens
  light chain complementarity determining region 3 for antibody 59174
QQYNSYPPT

SEQ ID NO: 118348 - protein, 12 aa, Homo sapiens
  heavy chain complementarity determining region 3 for antibody 59174
ARELEQHLVFDY

SEQ ID NO: 118349 - protein, 9 aa, Homo sapiens
  light chain complementarity determining region 3 for antibody 59175
QQYNSYPPT

SEQ ID NO: 118350 - protein, 12 aa, Homo sapiens
  heavy chain complementarity determining region 3 for antibody 59175
AREFEQQLVFDY

SEQ ID NO: 118351 - protein, 9 aa, Homo sapiens
  light chain complementarity determining region 3 for antibody 59176
QQYDNLPYT

SEQ ID NO: 118352 - protein, 12 aa, Homo sapiens
  heavy chain complementarity determining region 3 for antibody 59176
ATAVAGYWYFDL

SEQ ID NO: 118353 - protein, 9 aa, Homo sapiens
  light chain complementarity determining region 3 for antibody 59177
QQYDNLPYT

SEQ ID NO: 118354 - protein, 12 aa, Homo sapiens
  heavy chain complementarity determining region 3 for antibody 59177
ARSVAGYWYFDL

SEQ ID NO: 118355 - protein, 9 aa, Homo sapiens
  light chain complementarity determining region 3 for antibody 59178
QQYDNLPYT

SEQ ID NO: 118356 - protein, 12 aa, Homo sapiens
  heavy chain complementarity determining region 3 for antibody 59178
AREVAGYWYFDL

SEQ ID NO: 118357 - protein, 9 aa, Homo sapiens
  light chain complementarity determining region 3 for antibody 59179
QQYDNLPYT

SEQ ID NO: 118358 - protein, 12 aa, Homo sapiens
  heavy chain complementarity determining region 3 for antibody 59179
ARAVAGYWYFDH

SEQ ID NO: 118359 - protein, 9 aa, Homo sapiens
  light chain complementarity determining region 3 for antibody 59180
QQLNSYPRT

SEQ ID NO: 118360 - protein, 12 aa, Homo sapiens
  heavy chain complementarity determining region 3 for antibody 59180
ARKGSLTGVFDY

SEQ ID NO: 118361 - protein, 9 aa, Homo sapiens
  light chain complementarity determining region 3 for antibody 59181
QQFNNYPYT

SEQ ID NO: 118362 - protein, 15 aa, Homo sapiens
  heavy chain complementarity determining region 3 for antibody 59181
AREGFGEYLHWFFDL

SEQ ID NO: 118363 - protein, 9 aa, Homo sapiens
  light chain complementarity determining region 3 for antibody 59182
LQHNSYPPT

SEQ ID NO: 118364 - protein, 17 aa, Homo sapiens
  heavy chain complementarity determining region 3 for antibody 59182
AREGNDILTGYYHAFDL

SEQ ID NO: 118365 - protein, 9 aa, Homo sapiens
  light chain complementarity determining region 3 for antibody 59183
LQHNNYPYT

SEQ ID NO: 118366 - protein, 12 aa, Homo sapiens
  heavy chain complementarity determining region 3 for antibody 59183
ARDVFLFFGEYH

SEQ ID NO: 118367 - protein, 9 aa, Homo sapiens
  light chain complementarity determining region 3 for antibody 59184
LQDYNYPRT

SEQ ID NO: 118368 - protein, 11 aa, Homo sapiens
  heavy chain complementarity determining region 3 for antibody 59184
TRETLDRGSDY

SEQ ID NO: 118369 - protein, 9 aa, Homo sapiens
  light chain complementarity determining region 3 for antibody 59185
LQDYNYPRT

SEQ ID NO: 118370 - protein, 11 aa, Homo sapiens
  heavy chain complementarity determining region 3 for antibody 59185
TREKLERGFDY

SEQ ID NO: 118371 - protein, 9 aa, Homo sapiens
  light chain complementarity determining region 3 for antibody 59186
QQYNSYPPT

SEQ ID NO: 118372 - protein, 12 aa, Homo sapiens
  heavy chain complementarity determining region 3 for antibody 59186
ARELEQQLVFNY

SEQ ID NO: 118373 - protein, 9 aa, Homo sapiens
  light chain complementarity determining region 3 for antibody 59187
QQYDNLPYT

SEQ ID NO: 118374 - protein, 12 aa, Homo sapiens
  heavy chain complementarity determining region 3 for antibody 59187
ARAVAGCWYFDL

SEQ ID NO: 118375 - protein, 9 aa, Homo sapiens
  light chain complementarity determining region 3 for antibody 59188
QQFNNYPYT

SEQ ID NO: 118376 - protein, 15 aa, Homo sapiens
  heavy chain complementarity determining region 3 for antibody 59188
AREGFGESLHWCFDL

SEQ ID NO: 118377 - protein, 9 aa, Homo sapiens
  light chain complementarity determining region 3 for antibody 59189
LQHNNYPYT

SEQ ID NO: 118378 - protein, 12 aa, Homo sapiens
  heavy chain complementarity determining region 3 for antibody 59189
ARDVSLFFGESP

SEQ ID NO: 118379 - protein, 9 aa, Homo sapiens
  light chain complementarity determining region 3 for antibody 59190
LQDYNYPRT

SEQ ID NO: 118380 - protein, 11 aa, Homo sapiens
  heavy chain complementarity determining region 3 for antibody 59190
TRETLARGIDY

SEQ ID NO: 118381 - protein, 9 aa, Homo sapiens
  light chain complementarity determining region 3 for antibody 59191
LQDYNCPWT

SEQ ID NO: 118382 - protein, 11 aa, Homo sapiens
  heavy chain complementarity determining region 3 for antibody 59191
AREGALYGMDV

SEQ ID NO: 118383 - protein, 9 aa, Homo sapiens
  light chain complementarity determining region 3 for antibody 59192
QQYNSYPRT

SEQ ID NO: 118384 - protein, 5 aa, Homo sapiens
  heavy chain complementarity determining region 3 for antibody 59192
YGMDV

SEQ ID NO: 118385 - protein, 9 aa, Homo sapiens
  light chain complementarity determining region 3 for antibody 59193
QQYNSYPRT

SEQ ID NO: 118386 - protein, 17 aa, Homo sapiens
  heavy chain complementarity determining region 3 for antibody 59193
STAPVGTTLYYYSGMDV

SEQ ID NO: 118387 - protein, 9 aa, Homo sapiens
  light chain complementarity determining region 3 for antibody 59194
QQYNSYPRT

SEQ ID NO: 118388 - protein, 17 aa, Homo sapiens
  heavy chain complementarity determining region 3 for antibody 59194
SAAPVGTTLSYSYGMDV

SEQ ID NO: 118389 - protein, 9 aa, Homo sapiens
  light chain complementarity determining region 3 for antibody 59195
QQYDNLPYT

SEQ ID NO: 118390 - protein, 12 aa, Homo sapiens
  heavy chain complementarity determining region 3 for antibody 59195
ARAVSGYWYFDL

SEQ ID NO: 118391 - protein, 9 aa, Homo sapiens
  light chain complementarity determining region 3 for antibody 59196
QQYDNLPYT

SEQ ID NO: 118392 - protein, 12 aa, Homo sapiens
  heavy chain complementarity determining region 3 for antibody 59196
ARAVAGYWYFDV

SEQ ID NO: 118393 - protein, 9 aa, Homo sapiens
  light chain complementarity determining region 3 for antibody 59197
QQYDNLPYT

SEQ ID NO: 118394 - protein, 12 aa, Homo sapiens
  heavy chain complementarity determining region 3 for antibody 59197
ARAVAGYWYFAL

SEQ ID NO: 118395 - protein, 9 aa, Homo sapiens
  light chain complementarity determining region 3 for antibody 59198
QQYDNLPYT

SEQ ID NO: 118396 - protein, 9 aa, Homo sapiens
  heavy chain complementarity determining region 3 for antibody 59198
ANDGAVAQH

SEQ ID NO: 118397 - protein, 9 aa, Homo sapiens
  light chain complementarity determining region 3 for antibody 59199
QQYDNLPYT

SEQ ID NO: 118398 - protein, 9 aa, Homo sapiens
  heavy chain complementarity determining region 3 for antibody 59199
AKDGAVVQH

SEQ ID NO: 118399 - protein, 9 aa, Homo sapiens
  light chain complementarity determining region 3 for antibody 59200
QQFNNYPYT

SEQ ID NO: 118400 - protein, 15 aa, Homo sapiens
  heavy chain complementarity determining region 3 for antibody 59200
AREGFGESLHWVFDL

SEQ ID NO: 118401 - protein, 9 aa, Homo sapiens
  light chain complementarity determining region 3 for antibody 59201
QQFNNYPHT

SEQ ID NO: 118402 - protein, 11 aa, Homo sapiens
  heavy chain complementarity determining region 3 for antibody 59201
ARDGYSYYFAY

SEQ ID NO: 118403 - protein, 9 aa, Homo sapiens
  light chain complementarity determining region 3 for antibody 59202
LQHNSYPPT

SEQ ID NO: 118404 - protein, 17 aa, Homo sapiens
  heavy chain complementarity determining region 3 for antibody 59202
ASEGNDILTGYYHAFDI

SEQ ID NO: 118405 - protein, 9 aa, Homo sapiens
  light chain complementarity determining region 3 for antibody 59203
LQHNNYPYT

SEQ ID NO: 118406 - protein, 12 aa, Homo sapiens
  heavy chain complementarity determining region 3 for antibody 59203
ARDVFLFSGESP

SEQ ID NO: 118407 - protein, 9 aa, Homo sapiens
  light chain complementarity determining region 3 for antibody 59204
LQDYNYPRT

SEQ ID NO: 118408 - protein, 11 aa, Homo sapiens
  heavy chain complementarity determining region 3 for antibody 59204
TRETLGRGFDY

SEQ ID NO: 118409 - protein, 9 aa, Homo sapiens
  light chain complementarity determining region 3 for antibody 59205
LQDYNYPRT

SEQ ID NO: 118410 - protein, 11 aa, Homo sapiens
  heavy chain complementarity determining region 3 for antibody 59205
TRETLERVFDY

SEQ ID NO: 118411 - protein, 9 aa, Homo sapiens
  light chain complementarity determining region 3 for antibody 59206
LQDYNYPRT

SEQ ID NO: 118412 - protein, 11 aa, Homo sapiens
  heavy chain complementarity determining region 3 for antibody 59206
TRETLERGFDC

SEQ ID NO: 118413 - protein, 9 aa, Homo sapiens
  light chain complementarity determining region 3 for antibody 59207
LQDYNYPRT

SEQ ID NO: 118414 - protein, 11 aa, Homo sapiens
  heavy chain complementarity determining region 3 for antibody 59207
PRETLERGFDY

SEQ ID NO: 118415 - protein, 9 aa, Homo sapiens
  light chain complementarity determining region 3 for antibody 59208
KQLNSYPYT

SEQ ID NO: 118416 - protein, 19 aa, Homo sapiens
  heavy chain complementarity determining region 3 for antibody 59208
ARKGHYDILTGYYPDAFDI

SEQ ID NO: 118417 - protein, 9 aa, Homo sapiens
  light chain complementarity determining region 3 for antibody 59209
HQTSSLPLT

SEQ ID NO: 118418 - protein, 9 aa, Homo sapiens
  heavy chain complementarity determining region 3 for antibody 59209
ASDISATDY

SEQ ID NO: 118419 - protein, 9 aa, Homo sapiens
  light chain complementarity determining region 3 for antibody 59210
QQYNSYPYT

SEQ ID NO: 118420 - protein, 12 aa, Homo sapiens
  heavy chain complementarity determining region 3 for antibody 59210
ARVIGVWSPSDD

SEQ ID NO: 118421 - protein, 9 aa, Homo sapiens
  light chain complementarity determining region 3 for antibody 59211
QQYNSYPRT

SEQ ID NO: 118422 - protein, 17 aa, Homo sapiens
  heavy chain complementarity determining region 3 for antibody 59211
STAAVGTTLYYYYGMDV

SEQ ID NO: 118423 - protein, 9 aa, Homo sapiens
  light chain complementarity determining region 3 for antibody 59212
QQYKSYPYT

SEQ ID NO: 118424 - protein, 13 aa, Homo sapiens
  heavy chain complementarity determining region 3 for antibody 59212
ARERWEPGVDCEY

SEQ ID NO: 118425 - protein, 9 aa, Homo sapiens
  light chain complementarity determining region 3 for antibody 59213
QQYKSYPYT

SEQ ID NO: 118426 - protein, 13 aa, Homo sapiens
  heavy chain complementarity determining region 3 for antibody 59213
ARERWEPGGYCEY

SEQ ID NO: 118427 - protein, 9 aa, Homo sapiens
  light chain complementarity determining region 3 for antibody 59214
QQYGSSPYT

SEQ ID NO: 118428 - protein, 19 aa, Homo sapiens
  heavy chain complementarity determining region 3 for antibody 59214
ARGDSLLWSGELLPDAFDI

SEQ ID NO: 118429 - protein, 9 aa, Homo sapiens
  light chain complementarity determining region 3 for antibody 59215
QQLNSYPYT

SEQ ID NO: 118430 - protein, 19 aa, Homo sapiens
  heavy chain complementarity determining region 3 for antibody 59215
ARKGYYDILTGYYPDAFDI

SEQ ID NO: 118431 - protein, 9 aa, Homo sapiens
  light chain complementarity determining region 3 for antibody 59216
QQLNSYPYT

SEQ ID NO: 118432 - protein, 19 aa, Homo sapiens
  heavy chain complementarity determining region 3 for antibody 59216
ARKGHYDILTGYYPDAFDV

SEQ ID NO: 118433 - protein, 9 aa, Homo sapiens
  light chain complementarity determining region 3 for antibody 59217
QQLNSYPYT

SEQ ID NO: 118434 - protein, 19 aa, Homo sapiens
  heavy chain complementarity determining region 3 for antibody 59217
ARKGHDDILTGYYPDAFDI

SEQ ID NO: 118435 - protein, 9 aa, Homo sapiens
  light chain complementarity determining region 3 for antibody 59218
QQLNSYPLT

SEQ ID NO: 118436 - protein, 14 aa, Homo sapiens
  heavy chain complementarity determining region 3 for antibody 59218
ARGRSVLLWFGEDY

SEQ ID NO: 118437 - protein, 10 aa, Homo sapiens
  light chain complementarity determining region 3 for antibody 59219
QQFNSYPPHT

SEQ ID NO: 118438 - protein, 14 aa, Homo sapiens
  heavy chain complementarity determining region 3 for antibody 59219
ARDGRLTMVRGGDF

SEQ ID NO: 118439 - protein, 9 aa, Homo sapiens
  light chain complementarity determining region 3 for antibody 59220
QQFNNYPYT

SEQ ID NO: 118440 - protein, 15 aa, Homo sapiens
  heavy chain complementarity determining region 3 for antibody 59220
AREGFGESLHWFFEL

SEQ ID NO: 118441 - protein, 9 aa, Homo sapiens
  light chain complementarity determining region 3 for antibody 59221
QQFNNYPYT

SEQ ID NO: 118442 - protein, 15 aa, Homo sapiens
  heavy chain complementarity determining region 3 for antibody 59221
AREGFGESFHWSFDL

SEQ ID NO: 118443 - protein, 9 aa, Homo sapiens
  light chain complementarity determining region 3 for antibody 59222
QQFNNYPHT

SEQ ID NO: 118444 - protein, 11 aa, Homo sapiens
  heavy chain complementarity determining region 3 for antibody 59222
ARDGYSYYFDS

SEQ ID NO: 118445 - protein, 9 aa, Homo sapiens
  light chain complementarity determining region 3 for antibody 59223
QQFNNYPHT

SEQ ID NO: 118446 - protein, 11 aa, Homo sapiens
  heavy chain complementarity determining region 3 for antibody 59223
ARDGSSYYFDY

SEQ ID NO: 118447 - protein, 9 aa, Homo sapiens
  light chain complementarity determining region 3 for antibody 59224
LQHNSYPLT

SEQ ID NO: 118448 - protein, 15 aa, Homo sapiens
  heavy chain complementarity determining region 3 for antibody 59224
ARGGFGEFYSYGMDV

SEQ ID NO: 118449 - protein, 9 aa, Homo sapiens
  light chain complementarity determining region 3 for antibody 59225
LQDYNYPWT

SEQ ID NO: 118450 - protein, 11 aa, Homo sapiens
  heavy chain complementarity determining region 3 for antibody 59225
AREGARYGMDV

SEQ ID NO: 118451 - protein, 9 aa, Homo sapiens
  light chain complementarity determining region 3 for antibody 59226
LQDYNYPRT

SEQ ID NO: 118452 - protein, 11 aa, Homo sapiens
  heavy chain complementarity determining region 3 for antibody 59226
TRETLQRGFDY

SEQ ID NO: 118453 - protein, 9 aa, Homo sapiens
  light chain complementarity determining region 3 for antibody 59227
LQDYNYPRT

SEQ ID NO: 118454 - protein, 11 aa, Homo sapiens
  heavy chain complementarity determining region 3 for antibody 59227
TRDTLERAFDY

SEQ ID NO: 118455 - protein, 9 aa, Homo sapiens
  light chain complementarity determining region 3 for antibody 59228
HQTSSLPLT

SEQ ID NO: 118456 - protein, 9 aa, Homo sapiens
  heavy chain complementarity determining region 3 for antibody 59228
ARDTSATDY

SEQ ID NO: 118457 - protein, 9 aa, Homo sapiens
  light chain complementarity determining region 3 for antibody 59229
HQSSSLPWT

SEQ ID NO: 118458 - protein, 16 aa, Homo sapiens
  heavy chain complementarity determining region 3 for antibody 59229
ATDRYYYGSGSYPFDN

SEQ ID NO: 118459 - protein, 9 aa, Homo sapiens
  light chain complementarity determining region 3 for antibody 59230
QQYNSYPYT

SEQ ID NO: 118460 - protein, 20 aa, Homo sapiens
  heavy chain complementarity determining region 3 for antibody 59230
AREGVAAVGRVYYVYYGMDV

SEQ ID NO: 118461 - protein, 9 aa, Homo sapiens
  light chain complementarity determining region 3 for antibody 59231
QQYNSYPYT

SEQ ID NO: 118462 - protein, 20 aa, Homo sapiens
  heavy chain complementarity determining region 3 for antibody 59231
AREGVAAVGRGYYFYYGMDV

SEQ ID NO: 118463 - protein, 9 aa, Homo sapiens
  light chain complementarity determining region 3 for antibody 59232
QQYNSYPPT

SEQ ID NO: 118464 - protein, 12 aa, Homo sapiens
  heavy chain complementarity determining region 3 for antibody 59232
ARELDQQLVFDY

SEQ ID NO: 118465 - protein, 9 aa, Homo sapiens
  light chain complementarity determining region 3 for antibody 59233
QQYDNLPYT

SEQ ID NO: 118466 - protein, 12 aa, Homo sapiens
  heavy chain complementarity determining region 3 for antibody 59233
ARAVAGYWYFDF

SEQ ID NO: 118467 - protein, 9 aa, Homo sapiens
  light chain complementarity determining region 3 for antibody 59234
QQYDNLPYT

SEQ ID NO: 118468 - protein, 12 aa, Homo sapiens
  heavy chain complementarity determining region 3 for antibody 59234
ARAGAGYWYFDL

SEQ ID NO: 118469 - protein, 9 aa, Homo sapiens
  light chain complementarity determining region 3 for antibody 59235
QQYDNLPYT

SEQ ID NO: 118470 - protein, 9 aa, Homo sapiens
  heavy chain complementarity determining region 3 for antibody 59235
AKDGAGAQH

SEQ ID NO: 118471 - protein, 9 aa, Homo sapiens
  light chain complementarity determining region 3 for antibody 59236
QQLNSYPYT

SEQ ID NO: 118472 - protein, 19 aa, Homo sapiens
  heavy chain complementarity determining region 3 for antibody 59236
AGKGHYDILTGYYPDAFDI

SEQ ID NO: 118473 - protein, 9 aa, Homo sapiens
  light chain complementarity determining region 3 for antibody 59237
QQLNSYPWT

SEQ ID NO: 118474 - protein, 14 aa, Homo sapiens
  heavy chain complementarity determining region 3 for antibody 59237
ARREIAAAGSSFDY

SEQ ID NO: 118475 - protein, 9 aa, Homo sapiens
  light chain complementarity determining region 3 for antibody 59238
QQLNSYPLT

SEQ ID NO: 118476 - protein, 14 aa, Homo sapiens
  heavy chain complementarity determining region 3 for antibody 59238
ARGRSVSLWFGADY

SEQ ID NO: 118477 - protein, 9 aa, Homo sapiens
  light chain complementarity determining region 3 for antibody 59239
QQLNSYPLT

SEQ ID NO: 118478 - protein, 14 aa, Homo sapiens
  heavy chain complementarity determining region 3 for antibody 59239
ARGRSVLLWFGTDY

SEQ ID NO: 118479 - protein, 9 aa, Homo sapiens
  light chain complementarity determining region 3 for antibody 59240
QQFNNYPYT

SEQ ID NO: 118480 - protein, 15 aa, Homo sapiens
  heavy chain complementarity determining region 3 for antibody 59240
AREGFGESLHWYFDL

SEQ ID NO: 118481 - protein, 9 aa, Homo sapiens
  light chain complementarity determining region 3 for antibody 59241
QQFNNYPHT

SEQ ID NO: 118482 - protein, 11 aa, Homo sapiens
  heavy chain complementarity determining region 3 for antibody 59241
ARDGYSYSIDY

SEQ ID NO: 118483 - protein, 9 aa, Homo sapiens
  light chain complementarity determining region 3 for antibody 59242
LQHNSYPPT

SEQ ID NO: 118484 - protein, 17 aa, Homo sapiens
  heavy chain complementarity determining region 3 for antibody 59242
AREGNDIVTGYYHAFDI

SEQ ID NO: 118485 - protein, 9 aa, Homo sapiens
  light chain complementarity determining region 3 for antibody 59243
LQHNSYPPT

SEQ ID NO: 118486 - protein, 17 aa, Homo sapiens
  heavy chain complementarity determining region 3 for antibody 59243
AREGNDILTGYYHAFDV

SEQ ID NO: 118487 - protein, 9 aa, Homo sapiens
  light chain complementarity determining region 3 for antibody 59244
LQHNSYPPT

SEQ ID NO: 118488 - protein, 17 aa, Homo sapiens
  heavy chain complementarity determining region 3 for antibody 59244
AREGNDILTGYYHAFDN

SEQ ID NO: 118489 - protein, 9 aa, Homo sapiens
  light chain complementarity determining region 3 for antibody 59245
LQHNSYPPT

SEQ ID NO: 118490 - protein, 17 aa, Homo sapiens
  heavy chain complementarity determining region 3 for antibody 59245
AREGNDILTGYSHAFDI

SEQ ID NO: 118491 - protein, 9 aa, Homo sapiens
  light chain complementarity determining region 3 for antibody 59246
LQHNSYPPT

SEQ ID NO: 118492 - protein, 17 aa, Homo sapiens
  heavy chain complementarity determining region 3 for antibody 59246
AREGNDILTCYYHAFDI

SEQ ID NO: 118493 - protein, 9 aa, Homo sapiens
  light chain complementarity determining region 3 for antibody 59247
LQHNNYPYT

SEQ ID NO: 118494 - protein, 12 aa, Homo sapiens
  heavy chain complementarity determining region 3 for antibody 59247
ARDVFLFFGESH

SEQ ID NO: 118495 - protein, 9 aa, Homo sapiens
  light chain complementarity determining region 3 for antibody 59248
LQHNNYPYT

SEQ ID NO: 118496 - protein, 12 aa, Homo sapiens
  heavy chain complementarity determining region 3 for antibody 59248
ARDVFLFFGEAP

SEQ ID NO: 118497 - protein, 9 aa, Homo sapiens
  light chain complementarity determining region 3 for antibody 59249
LQDYNYPWT

SEQ ID NO: 118498 - protein, 15 aa, Homo sapiens
  heavy chain complementarity determining region 3 for antibody 59249
ARECGSYSSGWYFDY

SEQ ID NO: 118499 - protein, 9 aa, Homo sapiens
  light chain complementarity determining region 3 for antibody 59250
LQDYNYPRT

SEQ ID NO: 118500 - protein, 11 aa, Homo sapiens
  heavy chain complementarity determining region 3 for antibody 59250
TRETLERAIDY

SEQ ID NO: 118501 - protein, 9 aa, Homo sapiens
  light chain complementarity determining region 3 for antibody 59251
LQDYNYPRT

SEQ ID NO: 118502 - protein, 11 aa, Homo sapiens
  heavy chain complementarity determining region 3 for antibody 59251
TRETLDRGLDY

SEQ ID NO: 118503 - protein, 9 aa, Homo sapiens
  light chain complementarity determining region 3 for antibody 59252
LQDYNYPRT

SEQ ID NO: 118504 - protein, 11 aa, Homo sapiens
  heavy chain complementarity determining region 3 for antibody 59252
TREELERGFDY

SEQ ID NO: 118505 - protein, 9 aa, Homo sapiens
  light chain complementarity determining region 3 for antibody 59253
LQDYNYPRT

SEQ ID NO: 118506 - protein, 11 aa, Homo sapiens
  heavy chain complementarity determining region 3 for antibody 59253
TRDTLERGIDY

SEQ ID NO: 118507 - protein, 9 aa, Homo sapiens
  light chain complementarity determining region 3 for antibody 59254
LQDYNHPRT

SEQ ID NO: 118508 - protein, 11 aa, Homo sapiens
  heavy chain complementarity determining region 3 for antibody 59254
TRETLDRGFDY

SEQ ID NO: 118509 - protein, 9 aa, Homo sapiens
  light chain complementarity determining region 3 for antibody 59255
LQDYIYPWT

SEQ ID NO: 118510 - protein, 11 aa, Homo sapiens
  heavy chain complementarity determining region 3 for antibody 59255
ARDGAVAGPDY

SEQ ID NO: 118511 - protein, 9 aa, Homo sapiens
  light chain complementarity determining region 3 for antibody 59256
HQSSSLPWT

SEQ ID NO: 118512 - protein, 16 aa, Homo sapiens
  heavy chain complementarity determining region 3 for antibody 59256
ATDRDYYGSGSYPFDK

SEQ ID NO: 118513 - protein, 9 aa, Homo sapiens
  light chain complementarity determining region 3 for antibody 59257
QQYSSYPYT

SEQ ID NO: 118514 - protein, 20 aa, Homo sapiens
  heavy chain complementarity determining region 3 for antibody 59257
AREGVAAVGRVYYFYYGMDV

SEQ ID NO: 118515 - protein, 9 aa, Homo sapiens
  light chain complementarity determining region 3 for antibody 59258
QQYNSYPYT

SEQ ID NO: 118516 - protein, 12 aa, Homo sapiens
  heavy chain complementarity determining region 3 for antibody 59258
ARVIGVWSPFAD

SEQ ID NO: 118517 - protein, 9 aa, Homo sapiens
  light chain complementarity determining region 3 for antibody 59259
QQYNSYPRT

SEQ ID NO: 118518 - protein, 17 aa, Homo sapiens
  heavy chain complementarity determining region 3 for antibody 59259
STAPVGTTLSFYYGMDV

SEQ ID NO: 118519 - protein, 9 aa, Homo sapiens
  light chain complementarity determining region 3 for antibody 59260
QQYNSYPRT

SEQ ID NO: 118520 - protein, 17 aa, Homo sapiens
  heavy chain complementarity determining region 3 for antibody 59260
SAAPVGTTLYFYYGMDV

SEQ ID NO: 118521 - protein, 9 aa, Homo sapiens
  light chain complementarity determining region 3 for antibody 59261
QQYNSYPRT

SEQ ID NO: 118522 - protein, 17 aa, Homo sapiens
  heavy chain complementarity determining region 3 for antibody 59261
ATAPVGTTLYYSYGMDV

SEQ ID NO: 118523 - protein, 9 aa, Homo sapiens
  light chain complementarity determining region 3 for antibody 59262
QQYNSYPPT

SEQ ID NO: 118524 - protein, 12 aa, Homo sapiens
  heavy chain complementarity determining region 3 for antibody 59262
ARELEQQSVIDY

SEQ ID NO: 118525 - protein, 9 aa, Homo sapiens
  light chain complementarity determining region 3 for antibody 59263
QQYNSYPPT

SEQ ID NO: 118526 - protein, 12 aa, Homo sapiens
  heavy chain complementarity determining region 3 for antibody 59263
ARELEHQLVIDY

SEQ ID NO: 118527 - protein, 9 aa, Homo sapiens
  light chain complementarity determining region 3 for antibody 59264
QQYNSYPPT

SEQ ID NO: 118528 - protein, 12 aa, Homo sapiens
  heavy chain complementarity determining region 3 for antibody 59264
ARELAQQLAFDY

SEQ ID NO: 118529 - protein, 9 aa, Homo sapiens
  light chain complementarity determining region 3 for antibody 59265
QQYNSYPLT

SEQ ID NO: 118530 - protein, 14 aa, Homo sapiens
  heavy chain complementarity determining region 3 for antibody 59265
ARDRYGGNLNWFDH

SEQ ID NO: 118531 - protein, 9 aa, Homo sapiens
  light chain complementarity determining region 3 for antibody 59266
QQYGSSPYT

SEQ ID NO: 118532 - protein, 19 aa, Homo sapiens
  heavy chain complementarity determining region 3 for antibody 59266
ARGDSLLGFGELLPDAFDI

SEQ ID NO: 118533 - protein, 9 aa, Homo sapiens
  light chain complementarity determining region 3 for antibody 59267
QQYDNLPYT

SEQ ID NO: 118534 - protein, 12 aa, Homo sapiens
  heavy chain complementarity determining region 3 for antibody 59267
ERAVAGYWYFDL

SEQ ID NO: 118535 - protein, 9 aa, Homo sapiens
  light chain complementarity determining region 3 for antibody 59268
QQYDNLPYT

SEQ ID NO: 118536 - protein, 9 aa, Homo sapiens
  heavy chain complementarity determining region 3 for antibody 59268
ATDGAVAQH

SEQ ID NO: 118537 - protein, 9 aa, Homo sapiens
  light chain complementarity determining region 3 for antibody 59269
QQYDNLPYT

SEQ ID NO: 118538 - protein, 12 aa, Homo sapiens
  heavy chain complementarity determining region 3 for antibody 59269
ARAVAGYWYCDL

SEQ ID NO: 118539 - protein, 9 aa, Homo sapiens
  light chain complementarity determining region 3 for antibody 59270
QQYDNLPYT

SEQ ID NO: 118540 - protein, 9 aa, Homo sapiens
  heavy chain complementarity determining region 3 for antibody 59270
AKDGAVSQH

SEQ ID NO: 118541 - protein, 9 aa, Homo sapiens
  light chain complementarity determining region 3 for antibody 59271
QQWSSNPLT

SEQ ID NO: 118542 - protein, 4 aa, Homo sapiens
  heavy chain complementarity determining region 3 for antibody 59271
AYYG

SEQ ID NO: 118543 - protein, 9 aa, Homo sapiens
  light chain complementarity determining region 3 for antibody 59272
QQSYSTPFT

SEQ ID NO: 118544 - protein, 12 aa, Homo sapiens
  heavy chain complementarity determining region 3 for antibody 59272
ARLGWELHAFDY

SEQ ID NO: 118545 - protein, 9 aa, Homo sapiens
  light chain complementarity determining region 3 for antibody 59273
QQLNSYPYT

SEQ ID NO: 118546 - protein, 19 aa, Homo sapiens
  heavy chain complementarity determining region 3 for antibody 59273
ARKGHYDIMTGYYPDAFDI

SEQ ID NO: 118547 - protein, 9 aa, Homo sapiens
  light chain complementarity determining region 3 for antibody 59274
QQLNSYPYT

SEQ ID NO: 118548 - protein, 19 aa, Homo sapiens
  heavy chain complementarity determining region 3 for antibody 59274
ARKGHYDILTGYYPEAFDI

SEQ ID NO: 118549 - protein, 9 aa, Homo sapiens
  light chain complementarity determining region 3 for antibody 59275
QQLNSYPYT

SEQ ID NO: 118550 - protein, 13 aa, Homo sapiens
  heavy chain complementarity determining region 3 for antibody 59275
ARDQDYGSGSHDY

SEQ ID NO: 118551 - protein, 10 aa, Homo sapiens
  light chain complementarity determining region 3 for antibody 59276
QQFNSYPPYT

SEQ ID NO: 118552 - protein, 14 aa, Homo sapiens
  heavy chain complementarity determining region 3 for antibody 59276
ARDGRLTMARGGDF

SEQ ID NO: 118553 - protein, 9 aa, Homo sapiens
  light chain complementarity determining region 3 for antibody 59277
QQFNNYPHT

SEQ ID NO: 118554 - protein, 11 aa, Homo sapiens
  heavy chain complementarity determining region 3 for antibody 59277
ARDGFSYYFDY

SEQ ID NO: 118555 - protein, 9 aa, Homo sapiens
  light chain complementarity determining region 3 for antibody 59278
QQFNNYPHT

SEQ ID NO: 118556 - protein, 11 aa, Homo sapiens
  heavy chain complementarity determining region 3 for antibody 59278
ARDAYSYYFDY

SEQ ID NO: 118557 - protein, 9 aa, Homo sapiens
  light chain complementarity determining region 3 for antibody 59279
LQHNSYPPT

SEQ ID NO: 118558 - protein, 17 aa, Homo sapiens
  heavy chain complementarity determining region 3 for antibody 59279
AREGNDNLTGYYHAFDI

SEQ ID NO: 118559 - protein, 9 aa, Homo sapiens
  light chain complementarity determining region 3 for antibody 59280
LQHNSYPPT

SEQ ID NO: 118560 - protein, 17 aa, Homo sapiens
  heavy chain complementarity determining region 3 for antibody 59280
AREGNDILTGDYHAFDI

SEQ ID NO: 118561 - protein, 9 aa, Homo sapiens
  light chain complementarity determining region 3 for antibody 59281
LQHNSYPPT

SEQ ID NO: 118562 - protein, 17 aa, Homo sapiens
  heavy chain complementarity determining region 3 for antibody 59281
AIEGNDILTGYYHAFDI

SEQ ID NO: 118563 - protein, 9 aa, Homo sapiens
  light chain complementarity determining region 3 for antibody 59282
LQDYTYPWT

SEQ ID NO: 118564 - protein, 11 aa, Homo sapiens
  heavy chain complementarity determining region 3 for antibody 59282
AREGALYGMDV

SEQ ID NO: 118565 - protein, 9 aa, Homo sapiens
  light chain complementarity determining region 3 for antibody 59283
LQDYNYPRT

SEQ ID NO: 118566 - protein, 11 aa, Homo sapiens
  heavy chain complementarity determining region 3 for antibody 59283
TRETLYRAFDY

SEQ ID NO: 118567 - protein, 9 aa, Homo sapiens
  light chain complementarity determining region 3 for antibody 59284
LQDYNYPRT

SEQ ID NO: 118568 - protein, 11 aa, Homo sapiens
  heavy chain complementarity determining region 3 for antibody 59284
TRETLDQGFDY

SEQ ID NO: 118569 - protein, 9 aa, Homo sapiens
  light chain complementarity determining region 3 for antibody 59285
LQDYNYPRT

SEQ ID NO: 118570 - protein, 11 aa, Homo sapiens
  heavy chain complementarity determining region 3 for antibody 59285
TRETLARAFDY

SEQ ID NO: 118571 - protein, 9 aa, Homo sapiens
  light chain complementarity determining region 3 for antibody 59286
LQDYNYPRT

SEQ ID NO: 118572 - protein, 11 aa, Homo sapiens
  heavy chain complementarity determining region 3 for antibody 59286
TREPLDRGFDY

SEQ ID NO: 118573 - protein, 9 aa, Homo sapiens
  light chain complementarity determining region 3 for antibody 59287
LQDYNYPRT

SEQ ID NO: 118574 - protein, 11 aa, Homo sapiens
  heavy chain complementarity determining region 3 for antibody 59287
TRDTLDRAFDY

SEQ ID NO: 118575 - protein, 9 aa, Homo sapiens
  light chain complementarity determining region 3 for antibody 59288
LQDYNYPRT

SEQ ID NO: 118576 - protein, 11 aa, Homo sapiens
  heavy chain complementarity determining region 3 for antibody 59288
TRATLERGFDY

SEQ ID NO: 118577 - protein, 9 aa, Homo sapiens
  light chain complementarity determining region 3 for antibody 59289
HQYHRSPLT

SEQ ID NO: 118578 - protein, 11 aa, Homo sapiens
  heavy chain complementarity determining region 3 for antibody 59289
ARTPYSPAFDY

SEQ ID NO: 118579 - protein, 9 aa, Homo sapiens
  light chain complementarity determining region 3 for antibody 59290
HQTSSLPLT

SEQ ID NO: 118580 - protein, 9 aa, Homo sapiens
  heavy chain complementarity determining region 3 for antibody 59290
ASDISADDY

SEQ ID NO: 118581 - protein, 9 aa, Homo sapiens
  light chain complementarity determining region 3 for antibody 59291
HQTSGLPLT

SEQ ID NO: 118582 - protein, 9 aa, Homo sapiens
  heavy chain complementarity determining region 3 for antibody 59291
ARDISAADY

SEQ ID NO: 118583 - protein, 9 aa, Homo sapiens
  light chain complementarity determining region 3 for antibody 59292
HQSSSLPHT

SEQ ID NO: 118584 - protein, 13 aa, Homo sapiens
  heavy chain complementarity determining region 3 for antibody 59292
ARGGYYGSGSLDY

SEQ ID NO: 118585 - protein, 9 aa, Homo sapiens
  light chain complementarity determining region 3 for antibody 59293
RQYNSYPPT

SEQ ID NO: 118586 - protein, 12 aa, Homo sapiens
  heavy chain complementarity determining region 3 for antibody 59293
ARELEQQLVFDY

SEQ ID NO: 118587 - protein, 9 aa, Homo sapiens
  light chain complementarity determining region 3 for antibody 59294
QQYNSYPYT

SEQ ID NO: 118588 - protein, 12 aa, Homo sapiens
  heavy chain complementarity determining region 3 for antibody 59294
ARVIGVWSPFDY

SEQ ID NO: 118589 - protein, 9 aa, Homo sapiens
  light chain complementarity determining region 3 for antibody 59295
QQYNSYPYT

SEQ ID NO: 118590 - protein, 20 aa, Homo sapiens
  heavy chain complementarity determining region 3 for antibody 59295
AREGVAAVGRVYYFSYGMDV

SEQ ID NO: 118591 - protein, 9 aa, Homo sapiens
  light chain complementarity determining region 3 for antibody 59296
QQYNSYPRT

SEQ ID NO: 118592 - protein, 17 aa, Homo sapiens
  heavy chain complementarity determining region 3 for antibody 59296
STAPVGTTLYYYYGMDA

SEQ ID NO: 118593 - protein, 9 aa, Homo sapiens
  light chain complementarity determining region 3 for antibody 59297
QQYNSYPRT

SEQ ID NO: 118594 - protein, 17 aa, Homo sapiens
  heavy chain complementarity determining region 3 for antibody 59297
STAPVGTTLYYYYGIDV

SEQ ID NO: 118595 - protein, 9 aa, Homo sapiens
  light chain complementarity determining region 3 for antibody 59298
QQYNSYPRT

SEQ ID NO: 118596 - protein, 17 aa, Homo sapiens
  heavy chain complementarity determining region 3 for antibody 59298
STAPVGTTLYCYYGMDV

SEQ ID NO: 118597 - protein, 9 aa, Homo sapiens
  light chain complementarity determining region 3 for antibody 59299
QQYNSYPPT

SEQ ID NO: 118598 - protein, 12 aa, Homo sapiens
  heavy chain complementarity determining region 3 for antibody 59299
SRELEQQLVFDY

SEQ ID NO: 118599 - protein, 9 aa, Homo sapiens
  light chain complementarity determining region 3 for antibody 59300
QQYNSYPPT

SEQ ID NO: 118600 - protein, 12 aa, Homo sapiens
  heavy chain complementarity determining region 3 for antibody 59300
AREVEQQWVFDY

SEQ ID NO: 118601 - protein, 9 aa, Homo sapiens
  light chain complementarity determining region 3 for antibody 59301
QQYNSYPPT

SEQ ID NO: 118602 - protein, 12 aa, Homo sapiens
  heavy chain complementarity determining region 3 for antibody 59301
ARELEQQLVLDY

SEQ ID NO: 118603 - protein, 9 aa, Homo sapiens
  light chain complementarity determining region 3 for antibody 59302
QQYNSYPPT

SEQ ID NO: 118604 - protein, 12 aa, Homo sapiens
  heavy chain complementarity determining region 3 for antibody 59302
ARELEQQLDFDY

SEQ ID NO: 118605 - protein, 9 aa, Homo sapiens
  light chain complementarity determining region 3 for antibody 59303
QQYNSYPPT

SEQ ID NO: 118606 - protein, 12 aa, Homo sapiens
  heavy chain complementarity determining region 3 for antibody 59303
ARELELQLVFDY

SEQ ID NO: 118607 - protein, 9 aa, Homo sapiens
  light chain complementarity determining region 3 for antibody 59304
QQYNSYPPT

SEQ ID NO: 118608 - protein, 12 aa, Homo sapiens
  heavy chain complementarity determining region 3 for antibody 59304
ARELEHQSVFDY

SEQ ID NO: 118609 - protein, 9 aa, Homo sapiens
  light chain complementarity determining region 3 for antibody 59305
QQYNSYPPT

SEQ ID NO: 118610 - protein, 12 aa, Homo sapiens
  heavy chain complementarity determining region 3 for antibody 59305
ARELAHQLVFDY

SEQ ID NO: 118611 - protein, 10 aa, Homo sapiens
  light chain complementarity determining region 3 for antibody 59306
QQYNNWPPFT

SEQ ID NO: 118612 - protein, 14 aa, Homo sapiens
  heavy chain complementarity determining region 3 for antibody 59306
AREARGYSGYYFDY

SEQ ID NO: 118613 - protein, 9 aa, Homo sapiens
  light chain complementarity determining region 3 for antibody 59307
QQYKSYPYT

SEQ ID NO: 118614 - protein, 13 aa, Homo sapiens
  heavy chain complementarity determining region 3 for antibody 59307
ARERWEPGVSCEY

SEQ ID NO: 118615 - protein, 9 aa, Homo sapiens
  light chain complementarity determining region 3 for antibody 59308
QQYHSYPLT

SEQ ID NO: 118616 - protein, 11 aa, Homo sapiens
  heavy chain complementarity determining region 3 for antibody 59308
TRVRYGYYFDY

SEQ ID NO: 118617 - protein, 9 aa, Homo sapiens
  light chain complementarity determining region 3 for antibody 59309
QQYGSSPLT

SEQ ID NO: 118618 - protein, 12 aa, Homo sapiens
  heavy chain complementarity determining region 3 for antibody 59309
ASQQWLVPYFDC

SEQ ID NO: 118619 - protein, 9 aa, Homo sapiens
  light chain complementarity determining region 3 for antibody 59310
QQYGSSPLT

SEQ ID NO: 118620 - protein, 12 aa, Homo sapiens
  heavy chain complementarity determining region 3 for antibody 59310
ARQQWLVPYFDS

SEQ ID NO: 118621 - protein, 9 aa, Homo sapiens
  light chain complementarity determining region 3 for antibody 59311
QQYGSSPLT

SEQ ID NO: 118622 - protein, 12 aa, Homo sapiens
  heavy chain complementarity determining region 3 for antibody 59311
ARQQWLVPSFDC

SEQ ID NO: 118623 - protein, 9 aa, Homo sapiens
  light chain complementarity determining region 3 for antibody 59312
QQYDNLPYT

SEQ ID NO: 118624 - protein, 12 aa, Homo sapiens
  heavy chain complementarity determining region 3 for antibody 59312
ARAVAGYWYYDL

SEQ ID NO: 118625 - protein, 9 aa, Homo sapiens
  light chain complementarity determining region 3 for antibody 59313
QQYDNLPYT

SEQ ID NO: 118626 - protein, 12 aa, Homo sapiens
  heavy chain complementarity determining region 3 for antibody 59313
ARAVAGYWYLDL

SEQ ID NO: 118627 - protein, 9 aa, Homo sapiens
  light chain complementarity determining region 3 for antibody 59314
QQYDNLPYT

SEQ ID NO: 118628 - protein, 12 aa, Homo sapiens
  heavy chain complementarity determining region 3 for antibody 59314
ARAVAGYWDIDL

SEQ ID NO: 118629 - protein, 9 aa, Homo sapiens
  light chain complementarity determining region 3 for antibody 59315
QQYDNLPYT

SEQ ID NO: 118630 - protein, 12 aa, Homo sapiens
  heavy chain complementarity determining region 3 for antibody 59315
ARAVAGYGYFDL

SEQ ID NO: 118631 - protein, 9 aa, Homo sapiens
  light chain complementarity determining region 3 for antibody 59316
QQYDNLPYT

SEQ ID NO: 118632 - protein, 12 aa, Homo sapiens
  heavy chain complementarity determining region 3 for antibody 59316
ARAVAGSWSFDL

SEQ ID NO: 118633 - protein, 9 aa, Homo sapiens
  light chain complementarity determining region 3 for antibody 59317
QQYDNLPYT

SEQ ID NO: 118634 - protein, 12 aa, Homo sapiens
  heavy chain complementarity determining region 3 for antibody 59317
ARAVACYWYFDL

SEQ ID NO: 118635 - protein, 9 aa, Homo sapiens
  light chain complementarity determining region 3 for antibody 59318
QQSYSTPFT

SEQ ID NO: 118636 - protein, 12 aa, Homo sapiens
  heavy chain complementarity determining region 3 for antibody 59318
ASLGWELHDFDY

SEQ ID NO: 118637 - protein, 9 aa, Homo sapiens
  light chain complementarity determining region 3 for antibody 59319
QQLNSYPYT

SEQ ID NO: 118638 - protein, 19 aa, Homo sapiens
  heavy chain complementarity determining region 3 for antibody 59319
ARKGQYDSLTGYYPDAFDI

SEQ ID NO: 118639 - protein, 9 aa, Homo sapiens
  light chain complementarity determining region 3 for antibody 59320
QQLNSYPYT

SEQ ID NO: 118640 - protein, 19 aa, Homo sapiens
  heavy chain complementarity determining region 3 for antibody 59320
ARKGHYEILTGYYPDAFDI

SEQ ID NO: 118641 - protein, 9 aa, Homo sapiens
  light chain complementarity determining region 3 for antibody 59321
QQLNSYPYT

SEQ ID NO: 118642 - protein, 19 aa, Homo sapiens
  heavy chain complementarity determining region 3 for antibody 59321
ARKGHYDILTGYYPYAFDI

SEQ ID NO: 118643 - protein, 9 aa, Homo sapiens
  light chain complementarity determining region 3 for antibody 59322
QQLNSYPYT

SEQ ID NO: 118644 - protein, 13 aa, Homo sapiens
  heavy chain complementarity determining region 3 for antibody 59322
ARDQDYGSGSTDY

SEQ ID NO: 118645 - protein, 9 aa, Homo sapiens
  light chain complementarity determining region 3 for antibody 59323
QQLNSYPRT

SEQ ID NO: 118646 - protein, 15 aa, Homo sapiens
  heavy chain complementarity determining region 3 for antibody 59323
ARDENYYNYYSGMDV

SEQ ID NO: 118647 - protein, 8 aa, Homo sapiens
  light chain complementarity determining region 3 for antibody 59324
QQFNSYPT

SEQ ID NO: 118648 - protein, 13 aa, Homo sapiens
  heavy chain complementarity determining region 3 for antibody 59324
ARDVTGTTSGFDY

SEQ ID NO: 118649 - protein, 9 aa, Homo sapiens
  light chain complementarity determining region 3 for antibody 59325
QQFNNYPYT

SEQ ID NO: 118650 - protein, 12 aa, Homo sapiens
  heavy chain complementarity determining region 3 for antibody 59325
ARVWRFGESFDY

SEQ ID NO: 118651 - protein, 9 aa, Homo sapiens
  light chain complementarity determining region 3 for antibody 59326
LQYASSPLT

SEQ ID NO: 118652 - protein, 17 aa, Homo sapiens
  heavy chain complementarity determining region 3 for antibody 59326
ARDKGGDYYGSSHYFDY

SEQ ID NO: 118653 - protein, 9 aa, Homo sapiens
  light chain complementarity determining region 3 for antibody 59327
LQHNSYPPT

SEQ ID NO: 118654 - protein, 17 aa, Homo sapiens
  heavy chain complementarity determining region 3 for antibody 59327
AREGYDILTGYYHAFDI

SEQ ID NO: 118655 - protein, 9 aa, Homo sapiens
  light chain complementarity determining region 3 for antibody 59328
LQHNSYPPT

SEQ ID NO: 118656 - protein, 17 aa, Homo sapiens
  heavy chain complementarity determining region 3 for antibody 59328
AREGNEILTGYYHAFDI

SEQ ID NO: 118657 - protein, 9 aa, Homo sapiens
  light chain complementarity determining region 3 for antibody 59329
LQHNSYPPT

SEQ ID NO: 118658 - protein, 17 aa, Homo sapiens
  heavy chain complementarity determining region 3 for antibody 59329
AREGNDMLTGYYHAFDI

SEQ ID NO: 118659 - protein, 9 aa, Homo sapiens
  light chain complementarity determining region 3 for antibody 59330
LQHNNYPYT

SEQ ID NO: 118660 - protein, 12 aa, Homo sapiens
  heavy chain complementarity determining region 3 for antibody 59330
ARDVFLSFGEFP

SEQ ID NO: 118661 - protein, 9 aa, Homo sapiens
  light chain complementarity determining region 3 for antibody 59331
LQHNNYPYT

SEQ ID NO: 118662 - protein, 12 aa, Homo sapiens
  heavy chain complementarity determining region 3 for antibody 59331
ARDVFLFFGELP

SEQ ID NO: 118663 - protein, 9 aa, Homo sapiens
  light chain complementarity determining region 3 for antibody 59332
LQHNNYPYT

SEQ ID NO: 118664 - protein, 12 aa, Homo sapiens
  heavy chain complementarity determining region 3 for antibody 59332
ARDVFLFFGECP

SEQ ID NO: 118665 - protein, 9 aa, Homo sapiens
  light chain complementarity determining region 3 for antibody 59333
LQHDNFPYT

SEQ ID NO: 118666 - protein, 9 aa, Homo sapiens
  heavy chain complementarity determining region 3 for antibody 59333
ARQNWGLDY

SEQ ID NO: 118667 - protein, 9 aa, Homo sapiens
  light chain complementarity determining region 3 for antibody 59334
LQDYNYPWT

SEQ ID NO: 118668 - protein, 11 aa, Homo sapiens
  heavy chain complementarity determining region 3 for antibody 59334
AREGAHYGMDV

SEQ ID NO: 118669 - protein, 9 aa, Homo sapiens
  light chain complementarity determining region 3 for antibody 59335
LQDYNYPWT

SEQ ID NO: 118670 - protein, 15 aa, Homo sapiens
  heavy chain complementarity determining region 3 for antibody 59335
AREFGSYSSGWSFDY

SEQ ID NO: 118671 - protein, 9 aa, Homo sapiens
  light chain complementarity determining region 3 for antibody 59336
LQDYNYPRT

SEQ ID NO: 118672 - protein, 11 aa, Homo sapiens
  heavy chain complementarity determining region 3 for antibody 59336
TRETPDRGFDY

SEQ ID NO: 118673 - protein, 9 aa, Homo sapiens
  light chain complementarity determining region 3 for antibody 59337
LQDYNYPRT

SEQ ID NO: 118674 - protein, 11 aa, Homo sapiens
  heavy chain complementarity determining region 3 for antibody 59337
TRETLYRGIDY

SEQ ID NO: 118675 - protein, 9 aa, Homo sapiens
  light chain complementarity determining region 3 for antibody 59338
LQDYNYPRT

SEQ ID NO: 118676 - protein, 11 aa, Homo sapiens
  heavy chain complementarity determining region 3 for antibody 59338
TRETLHRGFDY

SEQ ID NO: 118677 - protein, 9 aa, Homo sapiens
  light chain complementarity determining region 3 for antibody 59339
LQDYNYPRT

SEQ ID NO: 118678 - protein, 11 aa, Homo sapiens
  heavy chain complementarity determining region 3 for antibody 59339
TRETLEWGFDY

SEQ ID NO: 118679 - protein, 9 aa, Homo sapiens
  light chain complementarity determining region 3 for antibody 59340
LQDYNYPRT

SEQ ID NO: 118680 - protein, 11 aa, Homo sapiens
  heavy chain complementarity determining region 3 for antibody 59340
TRETLERGIDS

SEQ ID NO: 118681 - protein, 9 aa, Homo sapiens
  light chain complementarity determining region 3 for antibody 59341
LQDYNYPRT

SEQ ID NO: 118682 - protein, 11 aa, Homo sapiens
  heavy chain complementarity determining region 3 for antibody 59341
TRETLEQGIDY

SEQ ID NO: 118683 - protein, 9 aa, Homo sapiens
  light chain complementarity determining region 3 for antibody 59342
LQDYNYPRT

SEQ ID NO: 118684 - protein, 11 aa, Homo sapiens
  heavy chain complementarity determining region 3 for antibody 59342
TRESLERGFDY

SEQ ID NO: 118685 - protein, 9 aa, Homo sapiens
  light chain complementarity determining region 3 for antibody 59343
LQDYNYPRT

SEQ ID NO: 118686 - protein, 11 aa, Homo sapiens
  heavy chain complementarity determining region 3 for antibody 59343
TRENLERGFDY

SEQ ID NO: 118687 - protein, 9 aa, Homo sapiens
  light chain complementarity determining region 3 for antibody 59344
LQDYNYPRT

SEQ ID NO: 118688 - protein, 11 aa, Homo sapiens
  heavy chain complementarity determining region 3 for antibody 59344
TRDTLYRGFDY

SEQ ID NO: 118689 - protein, 9 aa, Homo sapiens
  light chain complementarity determining region 3 for antibody 59345
LQDYNYPRT

SEQ ID NO: 118690 - protein, 11 aa, Homo sapiens
  heavy chain complementarity determining region 3 for antibody 59345
TRDTLERGFAY

SEQ ID NO: 118691 - protein, 9 aa, Homo sapiens
  light chain complementarity determining region 3 for antibody 59346
LQDYNYPRT

SEQ ID NO: 118692 - protein, 11 aa, Homo sapiens
  heavy chain complementarity determining region 3 for antibody 59346
TRDTLDRGFAS

SEQ ID NO: 118693 - protein, 9 aa, Homo sapiens
  light chain complementarity determining region 3 for antibody 59347
LQDYNYPRT

SEQ ID NO: 118694 - protein, 11 aa, Homo sapiens
  heavy chain complementarity determining region 3 for antibody 59347
TIETLDRGFDY

SEQ ID NO: 118695 - protein, 9 aa, Homo sapiens
  light chain complementarity determining region 3 for antibody 59348
LQDYNYPRT

SEQ ID NO: 118696 - protein, 11 aa, Homo sapiens
  heavy chain complementarity determining region 3 for antibody 59348
PRETLDRGFDY

SEQ ID NO: 118697 - protein, 9 aa, Homo sapiens
  light chain complementarity determining region 3 for antibody 59349
LQDYNYPRA

SEQ ID NO: 118698 - protein, 11 aa, Homo sapiens
  heavy chain complementarity determining region 3 for antibody 59349
TRETLDRGFDY

SEQ ID NO: 118699 - protein, 9 aa, Homo sapiens
  light chain complementarity determining region 3 for antibody 59350
HQSSSLPWT

SEQ ID NO: 118700 - protein, 16 aa, Homo sapiens
  heavy chain complementarity determining region 3 for antibody 59350
ATDRYSYGSGSYPFDK

SEQ ID NO: 118701 - protein, 9 aa, Homo sapiens
  light chain complementarity determining region 3 for antibody 59351
HQCSSLPHT

SEQ ID NO: 118702 - protein, 13 aa, Homo sapiens
  heavy chain complementarity determining region 3 for antibody 59351
ARGVYSSGWYFDY

SEQ ID NO: 118703 - protein, 9 aa, Homo sapiens
  light chain complementarity determining region 3 for antibody 59352
QQYNTWPRT

SEQ ID NO: 118704 - protein, 11 aa, Homo sapiens
  heavy chain complementarity determining region 3 for antibody 59352
ARDEGATFFDH

SEQ ID NO: 118705 - protein, 9 aa, Homo sapiens
  light chain complementarity determining region 3 for antibody 59353
QQYNSYSRT

SEQ ID NO: 118706 - protein, 17 aa, Homo sapiens
  heavy chain complementarity determining region 3 for antibody 59353
SAAPVGTTLYYYYGMDV

SEQ ID NO: 118707 - protein, 9 aa, Homo sapiens
  light chain complementarity determining region 3 for antibody 59354
QQYNSYPYT

SEQ ID NO: 118708 - protein, 20 aa, Homo sapiens
  heavy chain complementarity determining region 3 for antibody 59354
AREEVAAVGRVYYFYYGMDV

SEQ ID NO: 118709 - protein, 9 aa, Homo sapiens
  light chain complementarity determining region 3 for antibody 59355
QQYNSYPRT

SEQ ID NO: 118710 - protein, 17 aa, Homo sapiens
  heavy chain complementarity determining region 3 for antibody 59355
STAPVGTTLYYYYAMDV

SEQ ID NO: 118711 - protein, 9 aa, Homo sapiens
  light chain complementarity determining region 3 for antibody 59356
QQYNSYPRT

SEQ ID NO: 118712 - protein, 17 aa, Homo sapiens
  heavy chain complementarity determining region 3 for antibody 59356
STAPVGTTLYSYYGMDV

SEQ ID NO: 118713 - protein, 9 aa, Homo sapiens
  light chain complementarity determining region 3 for antibody 59357
QQYNSYPRT

SEQ ID NO: 118714 - protein, 17 aa, Homo sapiens
  heavy chain complementarity determining region 3 for antibody 59357
STAPVGTTLSYYYGMAV

SEQ ID NO: 118715 - protein, 9 aa, Homo sapiens
  light chain complementarity determining region 3 for antibody 59358
QQYNSYPRT

SEQ ID NO: 118716 - protein, 17 aa, Homo sapiens
  heavy chain complementarity determining region 3 for antibody 59358
ATAAVGTTLYYYYGMDV

SEQ ID NO: 118717 - protein, 9 aa, Homo sapiens
  light chain complementarity determining region 3 for antibody 59359
QQYNSYPPT

SEQ ID NO: 118718 - protein, 12 aa, Homo sapiens
  heavy chain complementarity determining region 3 for antibody 59359
ARELEHHLVFDY

SEQ ID NO: 118719 - protein, 9 aa, Homo sapiens
  light chain complementarity determining region 3 for antibody 59360
QQYGSSPYT

SEQ ID NO: 118720 - protein, 19 aa, Homo sapiens
  heavy chain complementarity determining region 3 for antibody 59360
ARGDSLLWFGESLPDAFDI

SEQ ID NO: 118721 - protein, 9 aa, Homo sapiens
  light chain complementarity determining region 3 for antibody 59361
QQYGSSPYT

SEQ ID NO: 118722 - protein, 19 aa, Homo sapiens
  heavy chain complementarity determining region 3 for antibody 59361
ARGDSLLWFGESFPDAFDI

SEQ ID NO: 118723 - protein, 9 aa, Homo sapiens
  light chain complementarity determining region 3 for antibody 59362
QQYGSSPLT

SEQ ID NO: 118724 - protein, 12 aa, Homo sapiens
  heavy chain complementarity determining region 3 for antibody 59362
ARQQWLVPYFDY

SEQ ID NO: 118725 - protein, 9 aa, Homo sapiens
  light chain complementarity determining region 3 for antibody 59363
QQYGSSPLT

SEQ ID NO: 118726 - protein, 12 aa, Homo sapiens
  heavy chain complementarity determining region 3 for antibody 59363
ARQQWLAPYFDC

SEQ ID NO: 118727 - protein, 9 aa, Homo sapiens
  light chain complementarity determining region 3 for antibody 59364
QQYDNLPYT

SEQ ID NO: 118728 - protein, 11 aa, Homo sapiens
  heavy chain complementarity determining region 3 for antibody 59364
TRETLERGFDY

SEQ ID NO: 118729 - protein, 9 aa, Homo sapiens
  light chain complementarity determining region 3 for antibody 59365
QQYDNLPYT

SEQ ID NO: 118730 - protein, 12 aa, Homo sapiens
  heavy chain complementarity determining region 3 for antibody 59365
ARAVAGYWYVDL

SEQ ID NO: 118731 - protein, 9 aa, Homo sapiens
  light chain complementarity determining region 3 for antibody 59366
QQYDNLPYT

SEQ ID NO: 118732 - protein, 12 aa, Homo sapiens
  heavy chain complementarity determining region 3 for antibody 59366
ARAVAGYWYFDI

SEQ ID NO: 118733 - protein, 9 aa, Homo sapiens
  light chain complementarity determining region 3 for antibody 59367
QQYDNLPYT

SEQ ID NO: 118734 - protein, 9 aa, Homo sapiens
  heavy chain complementarity determining region 3 for antibody 59367
AKDGAEAQH

SEQ ID NO: 118735 - protein, 9 aa, Homo sapiens
  light chain complementarity determining region 3 for antibody 59368
QQYDNLPYP

SEQ ID NO: 118736 - protein, 12 aa, Homo sapiens
  heavy chain complementarity determining region 3 for antibody 59368
ARAVAGYWYFDL

SEQ ID NO: 118737 - protein, 9 aa, Homo sapiens
  light chain complementarity determining region 3 for antibody 59369
QQVNSFPWT

SEQ ID NO: 118738 - protein, 7 aa, Homo sapiens
  heavy chain complementarity determining region 3 for antibody 59369
ARDVFDY

SEQ ID NO: 118739 - protein, 9 aa, Homo sapiens
  light chain complementarity determining region 3 for antibody 59370
QQLNSYPYT

SEQ ID NO: 118740 - protein, 19 aa, Homo sapiens
  heavy chain complementarity determining region 3 for antibody 59370
ASKGHYDILTGYYPDAFDI

SEQ ID NO: 118741 - protein, 9 aa, Homo sapiens
  light chain complementarity determining region 3 for antibody 59371
QQLNSYPYT

SEQ ID NO: 118742 - protein, 19 aa, Homo sapiens
  heavy chain complementarity determining region 3 for antibody 59371
ARKGHYDILTGYYSDAFDI

SEQ ID NO: 118743 - protein, 10 aa, Homo sapiens
  light chain complementarity determining region 3 for antibody 59372
QQFNSYPPYT

SEQ ID NO: 118744 - protein, 14 aa, Homo sapiens
  heavy chain complementarity determining region 3 for antibody 59372
ARDGRVTMVRGGDF

SEQ ID NO: 118745 - protein, 10 aa, Homo sapiens
  light chain complementarity determining region 3 for antibody 59373
QQFNSYPPYT

SEQ ID NO: 118746 - protein, 14 aa, Homo sapiens
  heavy chain complementarity determining region 3 for antibody 59373
ARDGRLTIVRGGDF

SEQ ID NO: 118747 - protein, 9 aa, Homo sapiens
  light chain complementarity determining region 3 for antibody 59374
QQFNNYPYT

SEQ ID NO: 118748 - protein, 15 aa, Homo sapiens
  heavy chain complementarity determining region 3 for antibody 59374
ASEGFGESLHWFFDL

SEQ ID NO: 118749 - protein, 9 aa, Homo sapiens
  light chain complementarity determining region 3 for antibody 59375
QQFNNYPYT

SEQ ID NO: 118750 - protein, 12 aa, Homo sapiens
  heavy chain complementarity determining region 3 for antibody 59375
ARVWRFAEFFDY

SEQ ID NO: 118751 - protein, 9 aa, Homo sapiens
  light chain complementarity determining region 3 for antibody 59376
QQFNNYPYT

SEQ ID NO: 118752 - protein, 15 aa, Homo sapiens
  heavy chain complementarity determining region 3 for antibody 59376
AREGFGDSLHWFFDL

SEQ ID NO: 118753 - protein, 9 aa, Homo sapiens
  light chain complementarity determining region 3 for antibody 59377
QQFNNYPYT

SEQ ID NO: 118754 - protein, 15 aa, Homo sapiens
  heavy chain complementarity determining region 3 for antibody 59377
ARDGFGESLHWFFDL

SEQ ID NO: 118755 - protein, 9 aa, Homo sapiens
  light chain complementarity determining region 3 for antibody 59378
QQFNNYPYT

SEQ ID NO: 118756 - protein, 15 aa, Homo sapiens
  heavy chain complementarity determining region 3 for antibody 59378
AGEGFGESLHWFFDL

SEQ ID NO: 118757 - protein, 9 aa, Homo sapiens
  light chain complementarity determining region 3 for antibody 59379
QQFNNYPHT

SEQ ID NO: 118758 - protein, 11 aa, Homo sapiens
  heavy chain complementarity determining region 3 for antibody 59379
ARDGYSYCFDY

SEQ ID NO: 118759 - protein, 9 aa, Homo sapiens
  light chain complementarity determining region 3 for antibody 59380
QKYNSAPLT

SEQ ID NO: 118760 - protein, 12 aa, Homo sapiens
  heavy chain complementarity determining region 3 for antibody 59380
ARLWFGQGPLDY

SEQ ID NO: 118761 - protein, 9 aa, Homo sapiens
  light chain complementarity determining region 3 for antibody 59381
LQHNSYPYT

SEQ ID NO: 118762 - protein, 15 aa, Homo sapiens
  heavy chain complementarity determining region 3 for antibody 59381
AGERGLWSGPEGMDV

SEQ ID NO: 118763 - protein, 9 aa, Homo sapiens
  light chain complementarity determining region 3 for antibody 59382
LQHNSYPYT

SEQ ID NO: 118764 - protein, 15 aa, Homo sapiens
  heavy chain complementarity determining region 3 for antibody 59382
AGEGGLWSGLEGMDV

SEQ ID NO: 118765 - protein, 9 aa, Homo sapiens
  light chain complementarity determining region 3 for antibody 59383
LQHNSYPPT

SEQ ID NO: 118766 - protein, 17 aa, Homo sapiens
  heavy chain complementarity determining region 3 for antibody 59383
AREGNDIFTGYYHAFDI

SEQ ID NO: 118767 - protein, 9 aa, Homo sapiens
  light chain complementarity determining region 3 for antibody 59384
LQHNSYPPT

SEQ ID NO: 118768 - protein, 17 aa, Homo sapiens
  heavy chain complementarity determining region 3 for antibody 59384
AREGHDILTGYYHAFDI

SEQ ID NO: 118769 - protein, 9 aa, Homo sapiens
  light chain complementarity determining region 3 for antibody 59385
LQHNSYPLT

SEQ ID NO: 118770 - protein, 15 aa, Homo sapiens
  heavy chain complementarity determining region 3 for antibody 59385
AGGGFGEFYYYGMDV

SEQ ID NO: 118771 - protein, 9 aa, Homo sapiens
  light chain complementarity determining region 3 for antibody 59386
LQHNNYPYT

SEQ ID NO: 118772 - protein, 12 aa, Homo sapiens
  heavy chain complementarity determining region 3 for antibody 59386
ARDVFLFFGKFP

SEQ ID NO: 118773 - protein, 9 aa, Homo sapiens
  light chain complementarity determining region 3 for antibody 59387
LQHNNYPYT

SEQ ID NO: 118774 - protein, 12 aa, Homo sapiens
  heavy chain complementarity determining region 3 for antibody 59387
ARDVFLFFGEDP

SEQ ID NO: 118775 - protein, 9 aa, Homo sapiens
  light chain complementarity determining region 3 for antibody 59388
LQHNNYPYT

SEQ ID NO: 118776 - protein, 12 aa, Homo sapiens
  heavy chain complementarity determining region 3 for antibody 59388
ARDVFLFCGESP

SEQ ID NO: 118777 - protein, 9 aa, Homo sapiens
  light chain complementarity determining region 3 for antibody 59389
LQDYNYPYT

SEQ ID NO: 118778 - protein, 13 aa, Homo sapiens
  heavy chain complementarity determining region 3 for antibody 59389
ARDRYCDWLSLDY

SEQ ID NO: 118779 - protein, 9 aa, Homo sapiens
  light chain complementarity determining region 3 for antibody 59390
LQDYNYPWT

SEQ ID NO: 118780 - protein, 11 aa, Homo sapiens
  heavy chain complementarity determining region 3 for antibody 59390
AREGALYGMDD

SEQ ID NO: 118781 - protein, 9 aa, Homo sapiens
  light chain complementarity determining region 3 for antibody 59391
LQDYNYPWT

SEQ ID NO: 118782 - protein, 11 aa, Homo sapiens
  heavy chain complementarity determining region 3 for antibody 59391
AREGALYGIDV

SEQ ID NO: 118783 - protein, 9 aa, Homo sapiens
  light chain complementarity determining region 3 for antibody 59392
LQDYNYPWT

SEQ ID NO: 118784 - protein, 20 aa, Homo sapiens
  heavy chain complementarity determining region 3 for antibody 59392
ARDGGDYGSGSHYYYYGMDV

SEQ ID NO: 118785 - protein, 9 aa, Homo sapiens
  light chain complementarity determining region 3 for antibody 59393
LQDYNYPRT

SEQ ID NO: 118786 - protein, 11 aa, Homo sapiens
  heavy chain complementarity determining region 3 for antibody 59393
TSETLDRGFDY

SEQ ID NO: 118787 - protein, 9 aa, Homo sapiens
  light chain complementarity determining region 3 for antibody 59394
LQDYNYPRT

SEQ ID NO: 118788 - protein, 11 aa, Homo sapiens
  heavy chain complementarity determining region 3 for antibody 59394
TRETLERGVDY

SEQ ID NO: 118789 - protein, 9 aa, Homo sapiens
  light chain complementarity determining region 3 for antibody 59395
LQDYNYPRT

SEQ ID NO: 118790 - protein, 11 aa, Homo sapiens
  heavy chain complementarity determining region 3 for antibody 59395
TRETLERGIAY

SEQ ID NO: 118791 - protein, 9 aa, Homo sapiens
  light chain complementarity determining region 3 for antibody 59396
LQDYNYPRT

SEQ ID NO: 118792 - protein, 11 aa, Homo sapiens
  heavy chain complementarity determining region 3 for antibody 59396
TRETLERGFNY

SEQ ID NO: 118793 - protein, 9 aa, Homo sapiens
  light chain complementarity determining region 3 for antibody 59397
LQDYNYPRT

SEQ ID NO: 118794 - protein, 11 aa, Homo sapiens
  heavy chain complementarity determining region 3 for antibody 59397
TRETLDRGFDD

SEQ ID NO: 118795 - protein, 9 aa, Homo sapiens
  light chain complementarity determining region 3 for antibody 59398
LQDYNYPRT

SEQ ID NO: 118796 - protein, 11 aa, Homo sapiens
  heavy chain complementarity determining region 3 for antibody 59398
TRETLDREFDY

SEQ ID NO: 118797 - protein, 9 aa, Homo sapiens
  light chain complementarity determining region 3 for antibody 59399
LQDYNYPRT

SEQ ID NO: 118798 - protein, 11 aa, Homo sapiens
  heavy chain complementarity determining region 3 for antibody 59399
TRETLARGFAY

SEQ ID NO: 118799 - protein, 9 aa, Homo sapiens
  light chain complementarity determining region 3 for antibody 59400
LQDYNYPRT

SEQ ID NO: 118800 - protein, 11 aa, Homo sapiens
  heavy chain complementarity determining region 3 for antibody 59400
TRDTLERGFDS

SEQ ID NO: 118801 - protein, 9 aa, Homo sapiens
  light chain complementarity determining region 3 for antibody 59401
LQDYNYPRT

SEQ ID NO: 118802 - protein, 11 aa, Homo sapiens
  heavy chain complementarity determining region 3 for antibody 59401
TRDTLARAFDY

SEQ ID NO: 118803 - protein, 9 aa, Homo sapiens
  light chain complementarity determining region 3 for antibody 59402
LQDYNYPRT

SEQ ID NO: 118804 - protein, 11 aa, Homo sapiens
  heavy chain complementarity determining region 3 for antibody 59402
SRETLERGFDY

SEQ ID NO: 118805 - protein, 9 aa, Homo sapiens
  light chain complementarity determining region 3 for antibody 59403
LQDYNSPYT

SEQ ID NO: 118806 - protein, 19 aa, Homo sapiens
  heavy chain complementarity determining region 3 for antibody 59403
ASSFNWNDGELYYYFGMDV

SEQ ID NO: 118807 - protein, 9 aa, Homo sapiens
  light chain complementarity determining region 3 for antibody 59404
LQDYKYPRT

SEQ ID NO: 118808 - protein, 11 aa, Homo sapiens
  heavy chain complementarity determining region 3 for antibody 59404
TRETLERGFDY

SEQ ID NO: 118809 - protein, 9 aa, Homo sapiens
  light chain complementarity determining region 3 for antibody 59405
LLHNTYPLT

SEQ ID NO: 118810 - protein, 12 aa, Homo sapiens
  heavy chain complementarity determining region 3 for antibody 59405
ARDRGSYRGMDV

SEQ ID NO: 118811 - protein, 9 aa, Homo sapiens
  light chain complementarity determining region 3 for antibody 59406
HQTSSLPLT

SEQ ID NO: 118812 - protein, 9 aa, Homo sapiens
  heavy chain complementarity determining region 3 for antibody 59406
ARDISAVDY

SEQ ID NO: 118813 - protein, 9 aa, Homo sapiens
  light chain complementarity determining region 3 for antibody 59407
RQLNSYPYT

SEQ ID NO: 118814 - protein, 19 aa, Homo sapiens
  heavy chain complementarity determining region 3 for antibody 59407
ARKGHYDSLTGYYPDAFDI

SEQ ID NO: 118815 - protein, 9 aa, Homo sapiens
  light chain complementarity determining region 3 for antibody 59408
QQYNSYSRT

SEQ ID NO: 118816 - protein, 17 aa, Homo sapiens
  heavy chain complementarity determining region 3 for antibody 59408
STAPVGTTLYYSYGMDV

SEQ ID NO: 118817 - protein, 9 aa, Homo sapiens
  light chain complementarity determining region 3 for antibody 59409
QQYNSYSLT

SEQ ID NO: 118818 - protein, 17 aa, Homo sapiens
  heavy chain complementarity determining region 3 for antibody 59409
STAPVGTTLYYYYGMDV

SEQ ID NO: 118819 - protein, 9 aa, Homo sapiens
  light chain complementarity determining region 3 for antibody 59410
QQYNSYPYT

SEQ ID NO: 118820 - protein, 12 aa, Homo sapiens
  heavy chain complementarity determining region 3 for antibody 59410
ARVIGVWSAFDD

SEQ ID NO: 118821 - protein, 9 aa, Homo sapiens
  light chain complementarity determining region 3 for antibody 59411
QQYNSYPYT

SEQ ID NO: 118822 - protein, 12 aa, Homo sapiens
  heavy chain complementarity determining region 3 for antibody 59411
ARLIGVWSPFDD

SEQ ID NO: 118823 - protein, 9 aa, Homo sapiens
  light chain complementarity determining region 3 for antibody 59412
QQYNSYPYT

SEQ ID NO: 118824 - protein, 20 aa, Homo sapiens
  heavy chain complementarity determining region 3 for antibody 59412
AREGVAAVGSVYYFYYGMDV

SEQ ID NO: 118825 - protein, 9 aa, Homo sapiens
  light chain complementarity determining region 3 for antibody 59413
QQYNSYPYT

SEQ ID NO: 118826 - protein, 20 aa, Homo sapiens
  heavy chain complementarity determining region 3 for antibody 59413
AREGVAAVGRVYYFYYGMAV

SEQ ID NO: 118827 - protein, 9 aa, Homo sapiens
  light chain complementarity determining region 3 for antibody 59414
QQYNSYPYT

SEQ ID NO: 118828 - protein, 20 aa, Homo sapiens
  heavy chain complementarity determining region 3 for antibody 59414
AREGVAAVGRVSYFYYGMDV

SEQ ID NO: 118829 - protein, 9 aa, Homo sapiens
  light chain complementarity determining region 3 for antibody 59415
QQYNSYPRT

SEQ ID NO: 118830 - protein, 17 aa, Homo sapiens
  heavy chain complementarity determining region 3 for antibody 59415
STAPVGTTLYYSSGMDV

SEQ ID NO: 118831 - protein, 9 aa, Homo sapiens
  light chain complementarity determining region 3 for antibody 59416
QQYNSYPRT

SEQ ID NO: 118832 - protein, 17 aa, Homo sapiens
  heavy chain complementarity determining region 3 for antibody 59416
STAPVGTTLSYYSGMDV

SEQ ID NO: 118833 - protein, 9 aa, Homo sapiens
  light chain complementarity determining region 3 for antibody 59417
QQYNSYPRT

SEQ ID NO: 118834 - protein, 17 aa, Homo sapiens
  heavy chain complementarity determining region 3 for antibody 59417
STAPVGTTLSSYYGMDV

SEQ ID NO: 118835 - protein, 9 aa, Homo sapiens
  light chain complementarity determining region 3 for antibody 59418
QQYNSYPRT

SEQ ID NO: 118836 - protein, 17 aa, Homo sapiens
  heavy chain complementarity determining region 3 for antibody 59418
STAPVGTTLCYYYGMDV

SEQ ID NO: 118837 - protein, 9 aa, Homo sapiens
  light chain complementarity determining region 3 for antibody 59419
QQYNSYPRT

SEQ ID NO: 118838 - protein, 17 aa, Homo sapiens
  heavy chain complementarity determining region 3 for antibody 59419
STAPEGTTLYYYYGMDV

SEQ ID NO: 118839 - protein, 9 aa, Homo sapiens
  light chain complementarity determining region 3 for antibody 59420
QQYNSYPRT

SEQ ID NO: 118840 - protein, 17 aa, Homo sapiens
  heavy chain complementarity determining region 3 for antibody 59420
STAPEGTTLSYYYGMDV

SEQ ID NO: 118841 - protein, 9 aa, Homo sapiens
  light chain complementarity determining region 3 for antibody 59421
QQYNSYPRT

SEQ ID NO: 118842 - protein, 17 aa, Homo sapiens
  heavy chain complementarity determining region 3 for antibody 59421
SAAPVGTTLSFYYGMDV

SEQ ID NO: 118843 - protein, 9 aa, Homo sapiens
  light chain complementarity determining region 3 for antibody 59422
QQYNSYPRT

SEQ ID NO: 118844 - protein, 17 aa, Homo sapiens
  heavy chain complementarity determining region 3 for antibody 59422
SAAAVGTTLYYYYGMDV

SEQ ID NO: 118845 - protein, 9 aa, Homo sapiens
  light chain complementarity determining region 3 for antibody 59423
QQYNSYPRT

SEQ ID NO: 118846 - protein, 17 aa, Homo sapiens
  heavy chain complementarity determining region 3 for antibody 59423
PTAPVGTTLYYYYGMDV

SEQ ID NO: 118847 - protein, 9 aa, Homo sapiens
  light chain complementarity determining region 3 for antibody 59424
QQYNSYPRT

SEQ ID NO: 118848 - protein, 17 aa, Homo sapiens
  heavy chain complementarity determining region 3 for antibody 59424
ATAPVGTTLSYSYGMDV

SEQ ID NO: 118849 - protein, 9 aa, Homo sapiens
  light chain complementarity determining region 3 for antibody 59425
QQYNSYPRT

SEQ ID NO: 118850 - protein, 17 aa, Homo sapiens
  heavy chain complementarity determining region 3 for antibody 59425
AAAPVGTTLSYSYGMDV

SEQ ID NO: 118851 - protein, 9 aa, Homo sapiens
  light chain complementarity determining region 3 for antibody 59426
QQYNSYPRK

SEQ ID NO: 118852 - protein, 17 aa, Homo sapiens
  heavy chain complementarity determining region 3 for antibody 59426
STAPVGTTLYYYYGMDV

SEQ ID NO: 118853 - protein, 9 aa, Homo sapiens
  light chain complementarity determining region 3 for antibody 59427
QQYNSYPPT

SEQ ID NO: 118854 - protein, 12 aa, Homo sapiens
  heavy chain complementarity determining region 3 for antibody 59427
AREVEQQLVIDY

SEQ ID NO: 118855 - protein, 9 aa, Homo sapiens
  light chain complementarity determining region 3 for antibody 59428
QQYNSYPPT

SEQ ID NO: 118856 - protein, 12 aa, Homo sapiens
  heavy chain complementarity determining region 3 for antibody 59428
AREVAQQLVFDY

SEQ ID NO: 118857 - protein, 9 aa, Homo sapiens
  light chain complementarity determining region 3 for antibody 59429
QQYNSYPPT

SEQ ID NO: 118858 - protein, 12 aa, Homo sapiens
  heavy chain complementarity determining region 3 for antibody 59429
ARELEQQLVCDY

SEQ ID NO: 118859 - protein, 9 aa, Homo sapiens
  light chain complementarity determining region 3 for antibody 59430
QQYNSYPPT

SEQ ID NO: 118860 - protein, 12 aa, Homo sapiens
  heavy chain complementarity determining region 3 for antibody 59430
ARELEQQLGFDY

SEQ ID NO: 118861 - protein, 9 aa, Homo sapiens
  light chain complementarity determining region 3 for antibody 59431
QQYNSYPPT

SEQ ID NO: 118862 - protein, 12 aa, Homo sapiens
  heavy chain complementarity determining region 3 for antibody 59431
ARELEQQLAIDY

SEQ ID NO: 118863 - protein, 9 aa, Homo sapiens
  light chain complementarity determining region 3 for antibody 59432
QQYNSYPPT

SEQ ID NO: 118864 - protein, 12 aa, Homo sapiens
  heavy chain complementarity determining region 3 for antibody 59432
ARELEHQLAFDY

SEQ ID NO: 118865 - protein, 9 aa, Homo sapiens
  light chain complementarity determining region 3 for antibody 59433
QQYNSYPPT

SEQ ID NO: 118866 - protein, 12 aa, Homo sapiens
  heavy chain complementarity determining region 3 for antibody 59433
ARELEHPLVFDY

SEQ ID NO: 118867 - protein, 9 aa, Homo sapiens
  light chain complementarity determining region 3 for antibody 59434
QQYNSYPPT

SEQ ID NO: 118868 - protein, 12 aa, Homo sapiens
  heavy chain complementarity determining region 3 for antibody 59434
ARELDQQSVFDY

SEQ ID NO: 118869 - protein, 9 aa, Homo sapiens
  light chain complementarity determining region 3 for antibody 59435
QQYNSYPPT

SEQ ID NO: 118870 - protein, 12 aa, Homo sapiens
  heavy chain complementarity determining region 3 for antibody 59435
ARELAQQLVIDY

SEQ ID NO: 118871 - protein, 9 aa, Homo sapiens
  light chain complementarity determining region 3 for antibody 59436
QQYNSFPRT

SEQ ID NO: 118872 - protein, 10 aa, Homo sapiens
  heavy chain complementarity determining region 3 for antibody 59436
ARGRLIGNNN

SEQ ID NO: 118873 - protein, 9 aa, Homo sapiens
  light chain complementarity determining region 3 for antibody 59437
QQYKSYPYT

SEQ ID NO: 118874 - protein, 13 aa, Homo sapiens
  heavy chain complementarity determining region 3 for antibody 59437
ARERWEPGVCCEY

SEQ ID NO: 118875 - protein, 9 aa, Homo sapiens
  light chain complementarity determining region 3 for antibody 59438
QQYKSYPYT

SEQ ID NO: 118876 - protein, 13 aa, Homo sapiens
  heavy chain complementarity determining region 3 for antibody 59438
ARERWEPGAYCEY

SEQ ID NO: 118877 - protein, 9 aa, Homo sapiens
  light chain complementarity determining region 3 for antibody 59439
QQYGSSPYT

SEQ ID NO: 118878 - protein, 19 aa, Homo sapiens
  heavy chain complementarity determining region 3 for antibody 59439
ARGDSLLWSGELFPDAFDI

SEQ ID NO: 118879 - protein, 9 aa, Homo sapiens
  light chain complementarity determining region 3 for antibody 59440
QQYGSSPYT

SEQ ID NO: 118880 - protein, 19 aa, Homo sapiens
  heavy chain complementarity determining region 3 for antibody 59440
ARGDSLLWFGEFLPDAFDI

SEQ ID NO: 118881 - protein, 9 aa, Homo sapiens
  light chain complementarity determining region 3 for antibody 59441
QQYGSSPYT

SEQ ID NO: 118882 - protein, 19 aa, Homo sapiens
  heavy chain complementarity determining region 3 for antibody 59441
ARGDSLLWFGDLLPDAFDI

SEQ ID NO: 118883 - protein, 9 aa, Homo sapiens
  light chain complementarity determining region 3 for antibody 59442
QQYGSSPYT

SEQ ID NO: 118884 - protein, 19 aa, Homo sapiens
  heavy chain complementarity determining region 3 for antibody 59442
ARGDSLLGFGELFPDAFDI

SEQ ID NO: 118885 - protein, 9 aa, Homo sapiens
  light chain complementarity determining region 3 for antibody 59443
QQYDNLPYT

SEQ ID NO: 118886 - protein, 9 aa, Homo sapiens
  heavy chain complementarity determining region 3 for antibody 59443
ANDGAVAHH

SEQ ID NO: 118887 - protein, 9 aa, Homo sapiens
  light chain complementarity determining region 3 for antibody 59444
QQYDNLPYT

SEQ ID NO: 118888 - protein, 9 aa, Homo sapiens
  heavy chain complementarity determining region 3 for antibody 59444
AKDGAVNQH

SEQ ID NO: 118889 - protein, 9 aa, Homo sapiens
  light chain complementarity determining region 3 for antibody 59445
QQYDNLPYT

SEQ ID NO: 118890 - protein, 9 aa, Homo sapiens
  heavy chain complementarity determining region 3 for antibody 59445
AKDAAVAQH

SEQ ID NO: 118891 - protein, 9 aa, Homo sapiens
  light chain complementarity determining region 3 for antibody 59446
QQYDNLPYT

SEQ ID NO: 118892 - protein, 12 aa, Homo sapiens
  heavy chain complementarity determining region 3 for antibody 59446
AGAVAGYWYFDL

SEQ ID NO: 118893 - protein, 9 aa, Homo sapiens
  light chain complementarity determining region 3 for antibody 59447
QQSYSTPFT

SEQ ID NO: 118894 - protein, 12 aa, Homo sapiens
  heavy chain complementarity determining region 3 for antibody 59447
ARLGWEPHDFDY

SEQ ID NO: 118895 - protein, 9 aa, Homo sapiens
  light chain complementarity determining region 3 for antibody 59448
QQLNSYPYT

SEQ ID NO: 118896 - protein, 19 aa, Homo sapiens
  heavy chain complementarity determining region 3 for antibody 59448
ARNGHYDILTGYYPDAFDI

SEQ ID NO: 118897 - protein, 9 aa, Homo sapiens
  light chain complementarity determining region 3 for antibody 59449
QQLNSYPYT

SEQ ID NO: 118898 - protein, 19 aa, Homo sapiens
  heavy chain complementarity determining region 3 for antibody 59449
ARKGQYDMLTGYYPDAFDI

SEQ ID NO: 118899 - protein, 9 aa, Homo sapiens
  light chain complementarity determining region 3 for antibody 59450
QQLNSYPYT

SEQ ID NO: 118900 - protein, 19 aa, Homo sapiens
  heavy chain complementarity determining region 3 for antibody 59450
ARKGPYDILTGYYPDAFDI

SEQ ID NO: 118901 - protein, 9 aa, Homo sapiens
  light chain complementarity determining region 3 for antibody 59451
QQLNSYPYT

SEQ ID NO: 118902 - protein, 19 aa, Homo sapiens
  heavy chain complementarity determining region 3 for antibody 59451
ARKGHYDIWTGYYPDAFDI

SEQ ID NO: 118903 - protein, 9 aa, Homo sapiens
  light chain complementarity determining region 3 for antibody 59452
QQLNSYPYT

SEQ ID NO: 118904 - protein, 19 aa, Homo sapiens
  heavy chain complementarity determining region 3 for antibody 59452
ARKGHYDILTGYYPDAIDI

SEQ ID NO: 118905 - protein, 9 aa, Homo sapiens
  light chain complementarity determining region 3 for antibody 59453
QQLNSYPYT

SEQ ID NO: 118906 - protein, 19 aa, Homo sapiens
  heavy chain complementarity determining region 3 for antibody 59453
ARKGHYDILTGDYPDAFDI

SEQ ID NO: 118907 - protein, 9 aa, Homo sapiens
  light chain complementarity determining region 3 for antibody 59454
QQLNSYPYT

SEQ ID NO: 118908 - protein, 19 aa, Homo sapiens
  heavy chain complementarity determining region 3 for antibody 59454
ARKGHYDILTCYYPDAFDI

SEQ ID NO: 118909 - protein, 9 aa, Homo sapiens
  light chain complementarity determining region 3 for antibody 59455
QQLNSYPYT

SEQ ID NO: 118910 - protein, 19 aa, Homo sapiens
  heavy chain complementarity determining region 3 for antibody 59455
ARKGHYDILAGYYPDAFDI

SEQ ID NO: 118911 - protein, 9 aa, Homo sapiens
  light chain complementarity determining region 3 for antibody 59456
QQLNSYPYT

SEQ ID NO: 118912 - protein, 19 aa, Homo sapiens
  heavy chain complementarity determining region 3 for antibody 59456
ARKCHYDILTGYYPDAFDI

SEQ ID NO: 118913 - protein, 9 aa, Homo sapiens
  light chain complementarity determining region 3 for antibody 59457
QQLNSYPYT

SEQ ID NO: 118914 - protein, 19 aa, Homo sapiens
  heavy chain complementarity determining region 3 for antibody 59457
AREGHYDSLTGYYPDAFDI

SEQ ID NO: 118915 - protein, 9 aa, Homo sapiens
  light chain complementarity determining region 3 for antibody 59458
QQLNSYPYT

SEQ ID NO: 118916 - protein, 19 aa, Homo sapiens
  heavy chain complementarity determining region 3 for antibody 59458
AIKGHYDILTGYYPDAFDI

SEQ ID NO: 118917 - protein, 9 aa, Homo sapiens
  light chain complementarity determining region 3 for antibody 59459
QQLNSYPRT

SEQ ID NO: 118918 - protein, 15 aa, Homo sapiens
  heavy chain complementarity determining region 3 for antibody 59459
ARDENYYNFYYGMDV

SEQ ID NO: 118919 - protein, 9 aa, Homo sapiens
  light chain complementarity determining region 3 for antibody 59460
QQLNSYPLT

SEQ ID NO: 118920 - protein, 14 aa, Homo sapiens
  heavy chain complementarity determining region 3 for antibody 59460
ARGRSVFLWSGADY

SEQ ID NO: 118921 - protein, 9 aa, Homo sapiens
  light chain complementarity determining region 3 for antibody 59461
QQLNSYPLT

SEQ ID NO: 118922 - protein, 14 aa, Homo sapiens
  heavy chain complementarity determining region 3 for antibody 59461
ARGRSVFLWFGTDY

SEQ ID NO: 118923 - protein, 9 aa, Homo sapiens
  light chain complementarity determining region 3 for antibody 59462
QQLNSYPLT

SEQ ID NO: 118924 - protein, 14 aa, Homo sapiens
  heavy chain complementarity determining region 3 for antibody 59462
AGGRSVLLWFGADY

SEQ ID NO: 118925 - protein, 9 aa, Homo sapiens
  light chain complementarity determining region 3 for antibody 59463
QQFNNYPYT

SEQ ID NO: 118926 - protein, 12 aa, Homo sapiens
  heavy chain complementarity determining region 3 for antibody 59463
ARVWTFGEFFDY

SEQ ID NO: 118927 - protein, 9 aa, Homo sapiens
  light chain complementarity determining region 3 for antibody 59464
QQFNNYPYT

SEQ ID NO: 118928 - protein, 15 aa, Homo sapiens
  heavy chain complementarity determining region 3 for antibody 59464
AREGSGESLHWFFDL

SEQ ID NO: 118929 - protein, 9 aa, Homo sapiens
  light chain complementarity determining region 3 for antibody 59465
QQFNNYPYT

SEQ ID NO: 118930 - protein, 15 aa, Homo sapiens
  heavy chain complementarity determining region 3 for antibody 59465
AREGFGESLHWFFDH

SEQ ID NO: 118931 - protein, 9 aa, Homo sapiens
  light chain complementarity determining region 3 for antibody 59466
QQFNNYPHT

SEQ ID NO: 118932 - protein, 11 aa, Homo sapiens
  heavy chain complementarity determining region 3 for antibody 59466
ARDGFSYSFDY

SEQ ID NO: 118933 - protein, 9 aa, Homo sapiens
  light chain complementarity determining region 3 for antibody 59467
QQFNNYPHT

SEQ ID NO: 118934 - protein, 11 aa, Homo sapiens
  heavy chain complementarity determining region 3 for antibody 59467
ARDGDSYYFDY

SEQ ID NO: 118935 - protein, 9 aa, Homo sapiens
  light chain complementarity determining region 3 for antibody 59468
QQDYKLPYT

SEQ ID NO: 118936 - protein, 10 aa, Homo sapiens
  heavy chain complementarity determining region 3 for antibody 59468
ARADYYAMDV

SEQ ID NO: 118937 - protein, 9 aa, Homo sapiens
  light chain complementarity determining region 3 for antibody 59469
LRDYNYPRT

SEQ ID NO: 118938 - protein, 11 aa, Homo sapiens
  heavy chain complementarity determining region 3 for antibody 59469
TRETLDRGFDY

SEQ ID NO: 118939 - protein, 9 aa, Homo sapiens
  light chain complementarity determining region 3 for antibody 59470
LQSDNLPFT

SEQ ID NO: 118940 - protein, 11 aa, Homo sapiens
  heavy chain complementarity determining region 3 for antibody 59470
TRGGSYYAKDY

SEQ ID NO: 118941 - protein, 9 aa, Homo sapiens
  light chain complementarity determining region 3 for antibody 59471
LQHSNYPYT

SEQ ID NO: 118942 - protein, 12 aa, Homo sapiens
  heavy chain complementarity determining region 3 for antibody 59471
ARDVFLFFGEFP

SEQ ID NO: 118943 - protein, 9 aa, Homo sapiens
  light chain complementarity determining region 3 for antibody 59472
LQHNSYTPT

SEQ ID NO: 118944 - protein, 17 aa, Homo sapiens
  heavy chain complementarity determining region 3 for antibody 59472
AREGNDILTGYYHAFDI

SEQ ID NO: 118945 - protein, 9 aa, Homo sapiens
  light chain complementarity determining region 3 for antibody 59473
LQHNSYPYT

SEQ ID NO: 118946 - protein, 15 aa, Homo sapiens
  heavy chain complementarity determining region 3 for antibody 59473
AGERGLWCGLEGMDV

SEQ ID NO: 118947 - protein, 9 aa, Homo sapiens
  light chain complementarity determining region 3 for antibody 59474
LQHNSYPPT

SEQ ID NO: 118948 - protein, 11 aa, Homo sapiens
  heavy chain complementarity determining region 3 for antibody 59474
TRETLERGFDY

SEQ ID NO: 118949 - protein, 9 aa, Homo sapiens
  light chain complementarity determining region 3 for antibody 59475
LQHNSYPPT

SEQ ID NO: 118950 - protein, 17 aa, Homo sapiens
  heavy chain complementarity determining region 3 for antibody 59475
AREGNDISTGYYHAFDI

SEQ ID NO: 118951 - protein, 9 aa, Homo sapiens
  light chain complementarity determining region 3 for antibody 59476
LQHNSYPPT

SEQ ID NO: 118952 - protein, 17 aa, Homo sapiens
  heavy chain complementarity determining region 3 for antibody 59476
AREGNDILTGYYHAFEI

SEQ ID NO: 118953 - protein, 9 aa, Homo sapiens
  light chain complementarity determining region 3 for antibody 59477
LQHNSYPPT

SEQ ID NO: 118954 - protein, 17 aa, Homo sapiens
  heavy chain complementarity determining region 3 for antibody 59477
AREGNDILTGYYHACDI

SEQ ID NO: 118955 - protein, 9 aa, Homo sapiens
  light chain complementarity determining region 3 for antibody 59478
LQHNSYPPT

SEQ ID NO: 118956 - protein, 17 aa, Homo sapiens
  heavy chain complementarity determining region 3 for antibody 59478
AREGKDILTGYYHAFDI

SEQ ID NO: 118957 - protein, 9 aa, Homo sapiens
  light chain complementarity determining region 3 for antibody 59479
LQHNSYPPT

SEQ ID NO: 118958 - protein, 17 aa, Homo sapiens
  heavy chain complementarity determining region 3 for antibody 59479
AREENDILTGYYHAFDI

SEQ ID NO: 118959 - protein, 9 aa, Homo sapiens
  light chain complementarity determining region 3 for antibody 59480
LQHNSYPLT

SEQ ID NO: 118960 - protein, 15 aa, Homo sapiens
  heavy chain complementarity determining region 3 for antibody 59480
ARGGFGEFYYSGMDV

SEQ ID NO: 118961 - protein, 9 aa, Homo sapiens
  light chain complementarity determining region 3 for antibody 59481
LQHNSYPLT

SEQ ID NO: 118962 - protein, 17 aa, Homo sapiens
  heavy chain complementarity determining region 3 for antibody 59481
AREGNDILTGYYHAFDI

SEQ ID NO: 118963 - protein, 9 aa, Homo sapiens
  light chain complementarity determining region 3 for antibody 59482
LQHNNYPYT

SEQ ID NO: 118964 - protein, 12 aa, Homo sapiens
  heavy chain complementarity determining region 3 for antibody 59482
ARDVFLFSGEFP

SEQ ID NO: 118965 - protein, 9 aa, Homo sapiens
  light chain complementarity determining region 3 for antibody 59483
LQHNNYPYT

SEQ ID NO: 118966 - protein, 12 aa, Homo sapiens
  heavy chain complementarity determining region 3 for antibody 59483
ARDVFLFFGEVH

SEQ ID NO: 118967 - protein, 9 aa, Homo sapiens
  light chain complementarity determining region 3 for antibody 59484
LQHNNYPYT

SEQ ID NO: 118968 - protein, 12 aa, Homo sapiens
  heavy chain complementarity determining region 3 for antibody 59484
ARDVCLFFGEFP

SEQ ID NO: 118969 - protein, 9 aa, Homo sapiens
  light chain complementarity determining region 3 for antibody 59485
LQGYNYPRT

SEQ ID NO: 118970 - protein, 11 aa, Homo sapiens
  heavy chain complementarity determining region 3 for antibody 59485
TRETLDRGFDY

SEQ ID NO: 118971 - protein, 9 aa, Homo sapiens
  light chain complementarity determining region 3 for antibody 59486
LQDYNYPWT

SEQ ID NO: 118972 - protein, 15 aa, Homo sapiens
  heavy chain complementarity determining region 3 for antibody 59486
AREVGSYSSGWYFDY

SEQ ID NO: 118973 - protein, 9 aa, Homo sapiens
  light chain complementarity determining region 3 for antibody 59487
LQDYNYPWT

SEQ ID NO: 118974 - protein, 11 aa, Homo sapiens
  heavy chain complementarity determining region 3 for antibody 59487
AREGALYGMDF

SEQ ID NO: 118975 - protein, 9 aa, Homo sapiens
  light chain complementarity determining region 3 for antibody 59488
LQDYNYPWT

SEQ ID NO: 118976 - protein, 11 aa, Homo sapiens
  heavy chain complementarity determining region 3 for antibody 59488
AREGALYAMDV

SEQ ID NO: 118977 - protein, 9 aa, Homo sapiens
  light chain complementarity determining region 3 for antibody 59489
LQDYNYPWT

SEQ ID NO: 118978 - protein, 11 aa, Homo sapiens
  heavy chain complementarity determining region 3 for antibody 59489
AREGALSGMDV

SEQ ID NO: 118979 - protein, 9 aa, Homo sapiens
  light chain complementarity determining region 3 for antibody 59490
LQDYNYPWT

SEQ ID NO: 118980 - protein, 15 aa, Homo sapiens
  heavy chain complementarity determining region 3 for antibody 59490
AREFASYSSGWYFDY

SEQ ID NO: 118981 - protein, 9 aa, Homo sapiens
  light chain complementarity determining region 3 for antibody 59491
LQDYNYPRT

SEQ ID NO: 118982 - protein, 11 aa, Homo sapiens
  heavy chain complementarity determining region 3 for antibody 59491
TRGTLERGFDY

SEQ ID NO: 118983 - protein, 9 aa, Homo sapiens
  light chain complementarity determining region 3 for antibody 59492
LQDYNYPRT

SEQ ID NO: 118984 - protein, 11 aa, Homo sapiens
  heavy chain complementarity determining region 3 for antibody 59492
TRETVDRGFDY

SEQ ID NO: 118985 - protein, 9 aa, Homo sapiens
  light chain complementarity determining region 3 for antibody 59493
LQDYNYPRT

SEQ ID NO: 118986 - protein, 11 aa, Homo sapiens
  heavy chain complementarity determining region 3 for antibody 59493
TRETLERGFHY

SEQ ID NO: 118987 - protein, 9 aa, Homo sapiens
  light chain complementarity determining region 3 for antibody 59494
LQDYNYPRT

SEQ ID NO: 118988 - protein, 11 aa, Homo sapiens
  heavy chain complementarity determining region 3 for antibody 59494
TRETLERGFDF

SEQ ID NO: 118989 - protein, 9 aa, Homo sapiens
  light chain complementarity determining region 3 for antibody 59495
LQDYNYPRT

SEQ ID NO: 118990 - protein, 11 aa, Homo sapiens
  heavy chain complementarity determining region 3 for antibody 59495
TRETLERGFAS

SEQ ID NO: 118991 - protein, 9 aa, Homo sapiens
  light chain complementarity determining region 3 for antibody 59496
LQDYNYPRT

SEQ ID NO: 118992 - protein, 11 aa, Homo sapiens
  heavy chain complementarity determining region 3 for antibody 59496
TRETLERAFDS

SEQ ID NO: 118993 - protein, 9 aa, Homo sapiens
  light chain complementarity determining region 3 for antibody 59497
LQDYNYPRT

SEQ ID NO: 118994 - protein, 11 aa, Homo sapiens
  heavy chain complementarity determining region 3 for antibody 59497
TRETLELGFDY

SEQ ID NO: 118995 - protein, 9 aa, Homo sapiens
  light chain complementarity determining region 3 for antibody 59498
LQDYNYPRT

SEQ ID NO: 118996 - protein, 11 aa, Homo sapiens
  heavy chain complementarity determining region 3 for antibody 59498
TRETLARGFDS

SEQ ID NO: 118997 - protein, 9 aa, Homo sapiens
  light chain complementarity determining region 3 for antibody 59499
LQDYNYPRT

SEQ ID NO: 118998 - protein, 11 aa, Homo sapiens
  heavy chain complementarity determining region 3 for antibody 59499
TREPLARGFDY

SEQ ID NO: 118999 - protein, 9 aa, Homo sapiens
  light chain complementarity determining region 3 for antibody 59500
LQDYNYPRT

SEQ ID NO: 119000 - protein, 11 aa, Homo sapiens
  heavy chain complementarity determining region 3 for antibody 59500
TREDLERGFDY

SEQ ID NO: 119001 - protein, 9 aa, Homo sapiens
  light chain complementarity determining region 3 for antibody 59501
LQDYNYPRT

SEQ ID NO: 119002 - protein, 11 aa, Homo sapiens
  heavy chain complementarity determining region 3 for antibody 59501
TRDTLDRGFDS

SEQ ID NO: 119003 - protein, 9 aa, Homo sapiens
  light chain complementarity determining region 3 for antibody 59502
LQDYNYPRT

SEQ ID NO: 119004 - protein, 11 aa, Homo sapiens
  heavy chain complementarity determining region 3 for antibody 59502
TRDTLDRGFAY

SEQ ID NO: 119005 - protein, 9 aa, Homo sapiens
  light chain complementarity determining region 3 for antibody 59503
LQDYNYPRT

SEQ ID NO: 119006 - protein, 11 aa, Homo sapiens
  heavy chain complementarity determining region 3 for antibody 59503
KRETLERGFDY

SEQ ID NO: 119007 - protein, 9 aa, Homo sapiens
  light chain complementarity determining region 3 for antibody 59504
LQDYNYPRT

SEQ ID NO: 119008 - protein, 13 aa, Homo sapiens
  heavy chain complementarity determining region 3 for antibody 59504
ALNYGDYGDWFDH

SEQ ID NO: 119009 - protein, 9 aa, Homo sapiens
  light chain complementarity determining region 3 for antibody 59505
LQDYNYPQT

SEQ ID NO: 119010 - protein, 11 aa, Homo sapiens
  heavy chain complementarity determining region 3 for antibody 59505
TRETLDRGFDY

SEQ ID NO: 119011 - protein, 9 aa, Homo sapiens
  light chain complementarity determining region 3 for antibody 59506
LQDYIYPWT

SEQ ID NO: 119012 - protein, 11 aa, Homo sapiens
  heavy chain complementarity determining region 3 for antibody 59506
ARDVAVAGLDY

SEQ ID NO: 119013 - protein, 9 aa, Homo sapiens
  light chain complementarity determining region 3 for antibody 59507
LQDYIYPWT

SEQ ID NO: 119014 - protein, 11 aa, Homo sapiens
  heavy chain complementarity determining region 3 for antibody 59507
ARDGAVAALDY

SEQ ID NO: 119015 - protein, 9 aa, Homo sapiens
  light chain complementarity determining region 3 for antibody 59508
LQDYIYPWT

SEQ ID NO: 119016 - protein, 11 aa, Homo sapiens
  heavy chain complementarity determining region 3 for antibody 59508
AGDGAVAGLDY

SEQ ID NO: 119017 - protein, 9 aa, Homo sapiens
  light chain complementarity determining region 3 for antibody 59509
LQDYDYPFT

SEQ ID NO: 119018 - protein, 14 aa, Homo sapiens
  heavy chain complementarity determining region 3 for antibody 59509
AREGLWFGENWFDH

SEQ ID NO: 119019 - protein, 9 aa, Homo sapiens
  light chain complementarity determining region 3 for antibody 59510
KQYDNLPYT

SEQ ID NO: 119020 - protein, 12 aa, Homo sapiens
  heavy chain complementarity determining region 3 for antibody 59510
ARAVAGYWYFDL

SEQ ID NO: 119021 - protein, 9 aa, Homo sapiens
  light chain complementarity determining region 3 for antibody 59511
HQYHRSPLT

SEQ ID NO: 119022 - protein, 11 aa, Homo sapiens
  heavy chain complementarity determining region 3 for antibody 59511
ARPPYFPAFDY

SEQ ID NO: 119023 - protein, 9 aa, Homo sapiens
  light chain complementarity determining region 3 for antibody 59512
HQTSSLPLT

SEQ ID NO: 119024 - protein, 9 aa, Homo sapiens
  heavy chain complementarity determining region 3 for antibody 59512
ATDISAADY

SEQ ID NO: 119025 - protein, 9 aa, Homo sapiens
  light chain complementarity determining region 3 for antibody 59513
HQTSSLPLT

SEQ ID NO: 119026 - protein, 9 aa, Homo sapiens
  heavy chain complementarity determining region 3 for antibody 59513
ARDISASDY

SEQ ID NO: 119027 - protein, 9 aa, Homo sapiens
  light chain complementarity determining region 3 for antibody 59514
HQSSSLPWT

SEQ ID NO: 119028 - protein, 16 aa, Homo sapiens
  heavy chain complementarity determining region 3 for antibody 59514
ASDRYYYGSGSYPFDK

SEQ ID NO: 119029 - protein, 9 aa, Homo sapiens
  light chain complementarity determining region 3 for antibody 59515
QRFNNYPYT

SEQ ID NO: 119030 - protein, 12 aa, Homo sapiens
  heavy chain complementarity determining region 3 for antibody 59515
ARVWRFAEFFDY

SEQ ID NO: 119031 - protein, 9 aa, Homo sapiens
  light chain complementarity determining region 3 for antibody 59516
QQYYNLPYT

SEQ ID NO: 119032 - protein, 12 aa, Homo sapiens
  heavy chain complementarity determining region 3 for antibody 59516
ARAVAGYWYFDL

SEQ ID NO: 119033 - protein, 9 aa, Homo sapiens
  light chain complementarity determining region 3 for antibody 59517
QQYNSYPYT

SEQ ID NO: 119034 - protein, 12 aa, Homo sapiens
  heavy chain complementarity determining region 3 for antibody 59517
GRVIGVWSPFDD

SEQ ID NO: 119035 - protein, 9 aa, Homo sapiens
  light chain complementarity determining region 3 for antibody 59518
QQYNSYPYT

SEQ ID NO: 119036 - protein, 15 aa, Homo sapiens
  heavy chain complementarity determining region 3 for antibody 59518
ASGRTFGESYYGMDV

SEQ ID NO: 119037 - protein, 9 aa, Homo sapiens
  light chain complementarity determining region 3 for antibody 59519
QQYNSYPYT

SEQ ID NO: 119038 - protein, 15 aa, Homo sapiens
  heavy chain complementarity determining region 3 for antibody 59519
ASGRRFVESYYGMDV

SEQ ID NO: 119039 - protein, 9 aa, Homo sapiens
  light chain complementarity determining region 3 for antibody 59520
QQYNSYPYT

SEQ ID NO: 119040 - protein, 12 aa, Homo sapiens
  heavy chain complementarity determining region 3 for antibody 59520
ARVRGVWSPFDD

SEQ ID NO: 119041 - protein, 9 aa, Homo sapiens
  light chain complementarity determining region 3 for antibody 59521
QQYNSYPYT

SEQ ID NO: 119042 - protein, 12 aa, Homo sapiens
  heavy chain complementarity determining region 3 for antibody 59521
ARVIGVWYPFDD

SEQ ID NO: 119043 - protein, 9 aa, Homo sapiens
  light chain complementarity determining region 3 for antibody 59522
QQYNSYPYT

SEQ ID NO: 119044 - protein, 12 aa, Homo sapiens
  heavy chain complementarity determining region 3 for antibody 59522
ARVIGVWAPFDD

SEQ ID NO: 119045 - protein, 9 aa, Homo sapiens
  light chain complementarity determining region 3 for antibody 59523
QQYNSYPYT

SEQ ID NO: 119046 - protein, 12 aa, Homo sapiens
  heavy chain complementarity determining region 3 for antibody 59523
ARVIGVCSPFDD

SEQ ID NO: 119047 - protein, 9 aa, Homo sapiens
  light chain complementarity determining region 3 for antibody 59524
QQYNSYPYT

SEQ ID NO: 119048 - protein, 20 aa, Homo sapiens
  heavy chain complementarity determining region 3 for antibody 59524
AREGVAAVGRVYYFYCGMDV

SEQ ID NO: 119049 - protein, 9 aa, Homo sapiens
  light chain complementarity determining region 3 for antibody 59525
QQYNSYPYT

SEQ ID NO: 119050 - protein, 20 aa, Homo sapiens
  heavy chain complementarity determining region 3 for antibody 59525
AREGVAAVGRVYCFYYGMDV

SEQ ID NO: 119051 - protein, 9 aa, Homo sapiens
  light chain complementarity determining region 3 for antibody 59526
QQYNSYPYT

SEQ ID NO: 119052 - protein, 20 aa, Homo sapiens
  heavy chain complementarity determining region 3 for antibody 59526
AREGVAAGGRVYYFYYGMDV

SEQ ID NO: 119053 - protein, 9 aa, Homo sapiens
  light chain complementarity determining region 3 for antibody 59527
QQYNSYPRT

SEQ ID NO: 119054 - protein, 17 aa, Homo sapiens
  heavy chain complementarity determining region 3 for antibody 59527
STAPVGTTLYYYYGMDF

SEQ ID NO: 119055 - protein, 9 aa, Homo sapiens
  light chain complementarity determining region 3 for antibody 59528
QQYNSYPRT

SEQ ID NO: 119056 - protein, 17 aa, Homo sapiens
  heavy chain complementarity determining region 3 for antibody 59528
STAPVGTTLYYSYGIDV

SEQ ID NO: 119057 - protein, 9 aa, Homo sapiens
  light chain complementarity determining region 3 for antibody 59529
QQYNSYPRT

SEQ ID NO: 119058 - protein, 17 aa, Homo sapiens
  heavy chain complementarity determining region 3 for antibody 59529
STAPVGTTLYDYYGMDV

SEQ ID NO: 119059 - protein, 9 aa, Homo sapiens
  light chain complementarity determining region 3 for antibody 59530
QQYNSYPRT

SEQ ID NO: 119060 - protein, 17 aa, Homo sapiens
  heavy chain complementarity determining region 3 for antibody 59530
STAPVGTTLSFSYGMDV

SEQ ID NO: 119061 - protein, 9 aa, Homo sapiens
  light chain complementarity determining region 3 for antibody 59531
QQYNSYPRT

SEQ ID NO: 119062 - protein, 17 aa, Homo sapiens
  heavy chain complementarity determining region 3 for antibody 59531
STAPVGTNLSYYYGMDV

SEQ ID NO: 119063 - protein, 9 aa, Homo sapiens
  light chain complementarity determining region 3 for antibody 59532
QQYNSYPRT

SEQ ID NO: 119064 - protein, 17 aa, Homo sapiens
  heavy chain complementarity determining region 3 for antibody 59532
STAPVGTALYYYYGMDV

SEQ ID NO: 119065 - protein, 9 aa, Homo sapiens
  light chain complementarity determining region 3 for antibody 59533
QQYNSYPRT

SEQ ID NO: 119066 - protein, 17 aa, Homo sapiens
  heavy chain complementarity determining region 3 for antibody 59533
STAAVGTTLSYYYGMDV

SEQ ID NO: 119067 - protein, 9 aa, Homo sapiens
  light chain complementarity determining region 3 for antibody 59534
QQYNSYPRT

SEQ ID NO: 119068 - protein, 17 aa, Homo sapiens
  heavy chain complementarity determining region 3 for antibody 59534
SPAPVGTTLYYYYGMDV

SEQ ID NO: 119069 - protein, 9 aa, Homo sapiens
  light chain complementarity determining region 3 for antibody 59535
QQYNSYPRT

SEQ ID NO: 119070 - protein, 17 aa, Homo sapiens
  heavy chain complementarity determining region 3 for antibody 59535
SAAPVGTTLYYYSGMDV

SEQ ID NO: 119071 - protein, 9 aa, Homo sapiens
  light chain complementarity determining region 3 for antibody 59536
QQYNSYPRT

SEQ ID NO: 119072 - protein, 17 aa, Homo sapiens
  heavy chain complementarity determining region 3 for antibody 59536
SAAPVGTTLYSYYGMDV

SEQ ID NO: 119073 - protein, 9 aa, Homo sapiens
  light chain complementarity determining region 3 for antibody 59537
QQYNSYPRT

SEQ ID NO: 119074 - protein, 17 aa, Homo sapiens
  heavy chain complementarity determining region 3 for antibody 59537
SAAPVGTTLSYYYGMDA

SEQ ID NO: 119075 - protein, 9 aa, Homo sapiens
  light chain complementarity determining region 3 for antibody 59538
QQYNSYPRT

SEQ ID NO: 119076 - protein, 17 aa, Homo sapiens
  heavy chain complementarity determining region 3 for antibody 59538
SAAPVGTTLSYYSGMDV

SEQ ID NO: 119077 - protein, 9 aa, Homo sapiens
  light chain complementarity determining region 3 for antibody 59539
QQYNSYPRT

SEQ ID NO: 119078 - protein, 17 aa, Homo sapiens
  heavy chain complementarity determining region 3 for antibody 59539
SAAPEGTTLYYYYGMDV

SEQ ID NO: 119079 - protein, 9 aa, Homo sapiens
  light chain complementarity determining region 3 for antibody 59540
QQYNSYPRT

SEQ ID NO: 119080 - protein, 17 aa, Homo sapiens
  heavy chain complementarity determining region 3 for antibody 59540
ASAPVGTTLYYYYGMDV

SEQ ID NO: 119081 - protein, 9 aa, Homo sapiens
  light chain complementarity determining region 3 for antibody 59541
QQYNSYPRT

SEQ ID NO: 119082 - protein, 17 aa, Homo sapiens
  heavy chain complementarity determining region 3 for antibody 59541
AAAPVGTTLYDYYGMDV

SEQ ID NO: 119083 - protein, 9 aa, Homo sapiens
  light chain complementarity determining region 3 for antibody 59542
QQYNSYPRT

SEQ ID NO: 119084 - protein, 17 aa, Homo sapiens
  heavy chain complementarity determining region 3 for antibody 59542
AAAPEGTTLYYYYGMDV

SEQ ID NO: 119085 - protein, 9 aa, Homo sapiens
  light chain complementarity determining region 3 for antibody 59543
QQYNSYPPT

SEQ ID NO: 119086 - protein, 12 aa, Homo sapiens
  heavy chain complementarity determining region 3 for antibody 59543
ATELEQQSVFDY

SEQ ID NO: 119087 - protein, 9 aa, Homo sapiens
  light chain complementarity determining region 3 for antibody 59544
QQYNSYPPT

SEQ ID NO: 119088 - protein, 12 aa, Homo sapiens
  heavy chain complementarity determining region 3 for antibody 59544
ATELEHQLVFDY

SEQ ID NO: 119089 - protein, 9 aa, Homo sapiens
  light chain complementarity determining region 3 for antibody 59545
QQYNSYPPT

SEQ ID NO: 119090 - protein, 12 aa, Homo sapiens
  heavy chain complementarity determining region 3 for antibody 59545
ASELEQQLAFDY

SEQ ID NO: 119091 - protein, 9 aa, Homo sapiens
  light chain complementarity determining region 3 for antibody 59546
QQYNSYPPT

SEQ ID NO: 119092 - protein, 12 aa, Homo sapiens
  heavy chain complementarity determining region 3 for antibody 59546
AREVEQHLVFDY

SEQ ID NO: 119093 - protein, 9 aa, Homo sapiens
  light chain complementarity determining region 3 for antibody 59547
QQYNSYPPT

SEQ ID NO: 119094 - protein, 12 aa, Homo sapiens
  heavy chain complementarity determining region 3 for antibody 59547
ARELEQQSAFDY

SEQ ID NO: 119095 - protein, 9 aa, Homo sapiens
  light chain complementarity determining region 3 for antibody 59548
QQYNSYPPT

SEQ ID NO: 119096 - protein, 12 aa, Homo sapiens
  heavy chain complementarity determining region 3 for antibody 59548
ARELEQQSAFAY

SEQ ID NO: 119097 - protein, 9 aa, Homo sapiens
  light chain complementarity determining region 3 for antibody 59549
QQYNSYPPT

SEQ ID NO: 119098 - protein, 12 aa, Homo sapiens
  heavy chain complementarity determining region 3 for antibody 59549
ARELEQPSVFDY

SEQ ID NO: 119099 - protein, 9 aa, Homo sapiens
  light chain complementarity determining region 3 for antibody 59550
QQYNSYPPT

SEQ ID NO: 119100 - protein, 12 aa, Homo sapiens
  heavy chain complementarity determining region 3 for antibody 59550
ARELEQPLAFDY

SEQ ID NO: 119101 - protein, 9 aa, Homo sapiens
  light chain complementarity determining region 3 for antibody 59551
QQYNSYPPT

SEQ ID NO: 119102 - protein, 12 aa, Homo sapiens
  heavy chain complementarity determining region 3 for antibody 59551
ARELEQHLAFDY

SEQ ID NO: 119103 - protein, 9 aa, Homo sapiens
  light chain complementarity determining region 3 for antibody 59552
QQYNSYPPT

SEQ ID NO: 119104 - protein, 12 aa, Homo sapiens
  heavy chain complementarity determining region 3 for antibody 59552
ARELEPQLVFDY

SEQ ID NO: 119105 - protein, 9 aa, Homo sapiens
  light chain complementarity determining region 3 for antibody 59553
QQYNSYPPT

SEQ ID NO: 119106 - protein, 12 aa, Homo sapiens
  heavy chain complementarity determining region 3 for antibody 59553
ARELEHQSAFDY

SEQ ID NO: 119107 - protein, 9 aa, Homo sapiens
  light chain complementarity determining region 3 for antibody 59554
QQYNSYPPT

SEQ ID NO: 119108 - protein, 12 aa, Homo sapiens
  heavy chain complementarity determining region 3 for antibody 59554
ARELEEQLVFDY

SEQ ID NO: 119109 - protein, 9 aa, Homo sapiens
  light chain complementarity determining region 3 for antibody 59555
QQYNSYPPT

SEQ ID NO: 119110 - protein, 12 aa, Homo sapiens
  heavy chain complementarity determining region 3 for antibody 59555
ARELAQQLAIDY

SEQ ID NO: 119111 - protein, 9 aa, Homo sapiens
  light chain complementarity determining region 3 for antibody 59556
QQYNSYPPT

SEQ ID NO: 119112 - protein, 12 aa, Homo sapiens
  heavy chain complementarity determining region 3 for antibody 59556
AIELEQQLVFDY

SEQ ID NO: 119113 - protein, 9 aa, Homo sapiens
  light chain complementarity determining region 3 for antibody 59557
QQYNSYPPA

SEQ ID NO: 119114 - protein, 12 aa, Homo sapiens
  heavy chain complementarity determining region 3 for antibody 59557
ARELEQQLVFDY

SEQ ID NO: 119115 - protein, 9 aa, Homo sapiens
  light chain complementarity determining region 3 for antibody 59558
QQYKSYPYT

SEQ ID NO: 119116 - protein, 13 aa, Homo sapiens
  heavy chain complementarity determining region 3 for antibody 59558
ARERWEAGVYCEY

SEQ ID NO: 119117 - protein, 9 aa, Homo sapiens
  light chain complementarity determining region 3 for antibody 59559
QQYGSSPYT

SEQ ID NO: 119118 - protein, 19 aa, Homo sapiens
  heavy chain complementarity determining region 3 for antibody 59559
AWGDSLLWFGELLPDAFDI

SEQ ID NO: 119119 - protein, 9 aa, Homo sapiens
  light chain complementarity determining region 3 for antibody 59560
QQYGSSPYT

SEQ ID NO: 119120 - protein, 19 aa, Homo sapiens
  heavy chain complementarity determining region 3 for antibody 59560
ARGDSLLWFGEFFPDAFDI

SEQ ID NO: 119121 - protein, 9 aa, Homo sapiens
  light chain complementarity determining region 3 for antibody 59561
QQYGSSPLT

SEQ ID NO: 119122 - protein, 12 aa, Homo sapiens
  heavy chain complementarity determining region 3 for antibody 59561
ARQQWLVPDFDC

SEQ ID NO: 119123 - protein, 9 aa, Homo sapiens
  light chain complementarity determining region 3 for antibody 59562
QQYGSSPLT

SEQ ID NO: 119124 - protein, 12 aa, Homo sapiens
  heavy chain complementarity determining region 3 for antibody 59562
ARQQWLLPYFDC

SEQ ID NO: 119125 - protein, 9 aa, Homo sapiens
  light chain complementarity determining region 3 for antibody 59563
QQYDNLQYT

SEQ ID NO: 119126 - protein, 12 aa, Homo sapiens
  heavy chain complementarity determining region 3 for antibody 59563
ARAVAGYWYFDL

SEQ ID NO: 119127 - protein, 9 aa, Homo sapiens
  light chain complementarity determining region 3 for antibody 59564
QQYDNLPYT

SEQ ID NO: 119128 - protein, 12 aa, Homo sapiens
  heavy chain complementarity determining region 3 for antibody 59564
VRAVAGYWYFDL

SEQ ID NO: 119129 - protein, 9 aa, Homo sapiens
  light chain complementarity determining region 3 for antibody 59565
QQYDNLPYT

SEQ ID NO: 119130 - protein, 12 aa, Homo sapiens
  heavy chain complementarity determining region 3 for antibody 59565
ASAVAGYWSFDL

SEQ ID NO: 119131 - protein, 9 aa, Homo sapiens
  light chain complementarity determining region 3 for antibody 59566
QQYDNLPYT

SEQ ID NO: 119132 - protein, 12 aa, Homo sapiens
  heavy chain complementarity determining region 3 for antibody 59566
ARVVAGYWSFDL

SEQ ID NO: 119133 - protein, 9 aa, Homo sapiens
  light chain complementarity determining region 3 for antibody 59567
QQYDNLPYT

SEQ ID NO: 119134 - protein, 12 aa, Homo sapiens
  heavy chain complementarity determining region 3 for antibody 59567
ARGVAGYWCFDL

SEQ ID NO: 119135 - protein, 9 aa, Homo sapiens
  light chain complementarity determining region 3 for antibody 59568
QQYDNLPYT

SEQ ID NO: 119136 - protein, 12 aa, Homo sapiens
  heavy chain complementarity determining region 3 for antibody 59568
ARAVAGYWYSDL

SEQ ID NO: 119137 - protein, 9 aa, Homo sapiens
  light chain complementarity determining region 3 for antibody 59569
QQYDNLPYT

SEQ ID NO: 119138 - protein, 12 aa, Homo sapiens
  heavy chain complementarity determining region 3 for antibody 59569
ARAVAGYWSFEL

SEQ ID NO: 119139 - protein, 9 aa, Homo sapiens
  light chain complementarity determining region 3 for antibody 59570
QQYDNLPYT

SEQ ID NO: 119140 - protein, 12 aa, Homo sapiens
  heavy chain complementarity determining region 3 for antibody 59570
ARAVAGYCYFDL

SEQ ID NO: 119141 - protein, 9 aa, Homo sapiens
  light chain complementarity determining region 3 for antibody 59571
QQYDNLPYT

SEQ ID NO: 119142 - protein, 9 aa, Homo sapiens
  heavy chain complementarity determining region 3 for antibody 59571
AKDGAVDHH

SEQ ID NO: 119143 - protein, 9 aa, Homo sapiens
  light chain complementarity determining region 3 for antibody 59572
QQYDNLPYT

SEQ ID NO: 119144 - protein, 9 aa, Homo sapiens
  heavy chain complementarity determining region 3 for antibody 59572
AKDGAVAPH

SEQ ID NO: 119145 - protein, 9 aa, Homo sapiens
  light chain complementarity determining region 3 for antibody 59573
QQYDNLPYT

SEQ ID NO: 119146 - protein, 12 aa, Homo sapiens
  heavy chain complementarity determining region 3 for antibody 59573
AKAVAGYWYFDL

SEQ ID NO: 119147 - protein, 9 aa, Homo sapiens
  light chain complementarity determining region 3 for antibody 59574
QQWSSNPLT

SEQ ID NO: 119148 - protein, 14 aa, Homo sapiens
  heavy chain complementarity determining region 3 for antibody 59574
ARLITTATPYAMDY

SEQ ID NO: 119149 - protein, 9 aa, Homo sapiens
  light chain complementarity determining region 3 for antibody 59575
QQVNSFPWT

SEQ ID NO: 119150 - protein, 7 aa, Homo sapiens
  heavy chain complementarity determining region 3 for antibody 59575
ARDCFDY

SEQ ID NO: 119151 - protein, 9 aa, Homo sapiens
  light chain complementarity determining region 3 for antibody 59576
QQSYSTPFT

SEQ ID NO: 119152 - protein, 12 aa, Homo sapiens
  heavy chain complementarity determining region 3 for antibody 59576
ARLGWDLHDFDY

SEQ ID NO: 119153 - protein, 9 aa, Homo sapiens
  light chain complementarity determining region 3 for antibody 59577
QQLNSYPYT

SEQ ID NO: 119154 - protein, 19 aa, Homo sapiens
  heavy chain complementarity determining region 3 for antibody 59577
ERKGHYDILTGYYPDAFDI

SEQ ID NO: 119155 - protein, 9 aa, Homo sapiens
  light chain complementarity determining region 3 for antibody 59578
QQLNSYPYT

SEQ ID NO: 119156 - protein, 19 aa, Homo sapiens
  heavy chain complementarity determining region 3 for antibody 59578
ARKGHYDILTVYYPDAFDI

SEQ ID NO: 119157 - protein, 9 aa, Homo sapiens
  light chain complementarity determining region 3 for antibody 59579
QQLNSYPYT

SEQ ID NO: 119158 - protein, 19 aa, Homo sapiens
  heavy chain complementarity determining region 3 for antibody 59579
ARKGHYDILTGYYPDAFDL

SEQ ID NO: 119159 - protein, 9 aa, Homo sapiens
  light chain complementarity determining region 3 for antibody 59580
QQLNSYPYT

SEQ ID NO: 119160 - protein, 19 aa, Homo sapiens
  heavy chain complementarity determining region 3 for antibody 59580
ARKGHYDILTGSYPDAFDI

SEQ ID NO: 119161 - protein, 9 aa, Homo sapiens
  light chain complementarity determining region 3 for antibody 59581
QQLNSYPYT

SEQ ID NO: 119162 - protein, 19 aa, Homo sapiens
  heavy chain complementarity determining region 3 for antibody 59581
ARKGHYDILSGYYPDAFDI

SEQ ID NO: 119163 - protein, 9 aa, Homo sapiens
  light chain complementarity determining region 3 for antibody 59582
QQLNSYPYT

SEQ ID NO: 119164 - protein, 19 aa, Homo sapiens
  heavy chain complementarity determining region 3 for antibody 59582
ARKGHHDILTGYYPDAFDI

SEQ ID NO: 119165 - protein, 9 aa, Homo sapiens
  light chain complementarity determining region 3 for antibody 59583
QQLNSYPYT

SEQ ID NO: 119166 - protein, 19 aa, Homo sapiens
  heavy chain complementarity determining region 3 for antibody 59583
ARKGDYDSLTGYYPDAFDI

SEQ ID NO: 119167 - protein, 9 aa, Homo sapiens
  light chain complementarity determining region 3 for antibody 59584
QQLNSYPRT

SEQ ID NO: 119168 - protein, 15 aa, Homo sapiens
  heavy chain complementarity determining region 3 for antibody 59584
ARDENYYNYSFGMDV

SEQ ID NO: 119169 - protein, 9 aa, Homo sapiens
  light chain complementarity determining region 3 for antibody 59585
QQLNSYPRT

SEQ ID NO: 119170 - protein, 15 aa, Homo sapiens
  heavy chain complementarity determining region 3 for antibody 59585
ARDENCYNYYYGMDV

SEQ ID NO: 119171 - protein, 9 aa, Homo sapiens
  light chain complementarity determining region 3 for antibody 59586
QQLNSYPRT

SEQ ID NO: 119172 - protein, 15 aa, Homo sapiens
  heavy chain complementarity determining region 3 for antibody 59586
ARDENCYNYYCGMDV

SEQ ID NO: 119173 - protein, 9 aa, Homo sapiens
  light chain complementarity determining region 3 for antibody 59587
QQLNSYPRT

SEQ ID NO: 119174 - protein, 15 aa, Homo sapiens
  heavy chain complementarity determining region 3 for antibody 59587
ARDEKYYNYYFGMDV

SEQ ID NO: 119175 - protein, 9 aa, Homo sapiens
  light chain complementarity determining region 3 for antibody 59588
QQLNSYPLT

SEQ ID NO: 119176 - protein, 14 aa, Homo sapiens
  heavy chain complementarity determining region 3 for antibody 59588
ARGRSVSLWSGADY

SEQ ID NO: 119177 - protein, 9 aa, Homo sapiens
  light chain complementarity determining region 3 for antibody 59589
QQLNSYPLT

SEQ ID NO: 119178 - protein, 14 aa, Homo sapiens
  heavy chain complementarity determining region 3 for antibody 59589
ARGRSVLLWCGADY

SEQ ID NO: 119179 - protein, 9 aa, Homo sapiens
  light chain complementarity determining region 3 for antibody 59590
QQLNSYPLT

SEQ ID NO: 119180 - protein, 14 aa, Homo sapiens
  heavy chain complementarity determining region 3 for antibody 59590
ARGRSVFLWFGKDY

SEQ ID NO: 119181 - protein, 9 aa, Homo sapiens
  light chain complementarity determining region 3 for antibody 59591
QQLNSYPLT

SEQ ID NO: 119182 - protein, 14 aa, Homo sapiens
  heavy chain complementarity determining region 3 for antibody 59591
ARGRSVFLWFGEDY

SEQ ID NO: 119183 - protein, 9 aa, Homo sapiens
  light chain complementarity determining region 3 for antibody 59592
QQHYSTPPT

SEQ ID NO: 119184 - protein, 11 aa, Homo sapiens
  heavy chain complementarity determining region 3 for antibody 59592
TREGNYYAMDY

SEQ ID NO: 119185 - protein, 10 aa, Homo sapiens
  light chain complementarity determining region 3 for antibody 59593
QQFNSYPPYT

SEQ ID NO: 119186 - protein, 14 aa, Homo sapiens
  heavy chain complementarity determining region 3 for antibody 59593
ARDGRLTVVRGGDF

SEQ ID NO: 119187 - protein, 10 aa, Homo sapiens
  light chain complementarity determining region 3 for antibody 59594
QQFNSYPPYT

SEQ ID NO: 119188 - protein, 14 aa, Homo sapiens
  heavy chain complementarity determining region 3 for antibody 59594
ARDGRLTMVRGVDF

SEQ ID NO: 119189 - protein, 10 aa, Homo sapiens
  light chain complementarity determining region 3 for antibody 59595
QQFNSYPPYT

SEQ ID NO: 119190 - protein, 14 aa, Homo sapiens
  heavy chain complementarity determining region 3 for antibody 59595
ARDGRLTMVRGGDY

SEQ ID NO: 119191 - protein, 10 aa, Homo sapiens
  light chain complementarity determining region 3 for antibody 59596
QQFNSYPPYT

SEQ ID NO: 119192 - protein, 14 aa, Homo sapiens
  heavy chain complementarity determining region 3 for antibody 59596
ARDGRLTMVRGGAF

SEQ ID NO: 119193 - protein, 10 aa, Homo sapiens
  light chain complementarity determining region 3 for antibody 59597
QQFNSYPPYT

SEQ ID NO: 119194 - protein, 14 aa, Homo sapiens
  heavy chain complementarity determining region 3 for antibody 59597
ARDGRLTMGRGGDF

SEQ ID NO: 119195 - protein, 10 aa, Homo sapiens
  light chain complementarity determining region 3 for antibody 59598
QQFNSYPPYT

SEQ ID NO: 119196 - protein, 14 aa, Homo sapiens
  heavy chain complementarity determining region 3 for antibody 59598
ARDGRLTLVRGGDF

SEQ ID NO: 119197 - protein, 10 aa, Homo sapiens
  light chain complementarity determining region 3 for antibody 59599
QQFNSYPPYT

SEQ ID NO: 119198 - protein, 14 aa, Homo sapiens
  heavy chain complementarity determining region 3 for antibody 59599
ARDARLTMVRGGDF

SEQ ID NO: 119199 - protein, 9 aa, Homo sapiens
  light chain complementarity determining region 3 for antibody 59600
QQFNNYPYT

SEQ ID NO: 119200 - protein, 12 aa, Homo sapiens
  heavy chain complementarity determining region 3 for antibody 59600
ARVWRFGEFIDY

SEQ ID NO: 119201 - protein, 9 aa, Homo sapiens
  light chain complementarity determining region 3 for antibody 59601
QQFNNYPYT

SEQ ID NO: 119202 - protein, 15 aa, Homo sapiens
  heavy chain complementarity determining region 3 for antibody 59601
AREGFWESLHWFFDL

SEQ ID NO: 119203 - protein, 9 aa, Homo sapiens
  light chain complementarity determining region 3 for antibody 59602
QQFNNYPYT

SEQ ID NO: 119204 - protein, 15 aa, Homo sapiens
  heavy chain complementarity determining region 3 for antibody 59602
AREGFGESVHWFFDL

SEQ ID NO: 119205 - protein, 9 aa, Homo sapiens
  light chain complementarity determining region 3 for antibody 59603
QQFNNYPYT

SEQ ID NO: 119206 - protein, 15 aa, Homo sapiens
  heavy chain complementarity determining region 3 for antibody 59603
AREGFGESFPWFFDL

SEQ ID NO: 119207 - protein, 9 aa, Homo sapiens
  light chain complementarity determining region 3 for antibody 59604
QQFNNYPYT

SEQ ID NO: 119208 - protein, 15 aa, Homo sapiens
  heavy chain complementarity determining region 3 for antibody 59604
AREGCGESLHWFFDL

SEQ ID NO: 119209 - protein, 9 aa, Homo sapiens
  light chain complementarity determining region 3 for antibody 59605
QQFNNYPYA

SEQ ID NO: 119210 - protein, 15 aa, Homo sapiens
  heavy chain complementarity determining region 3 for antibody 59605
AREGFGESFHWFFDL

SEQ ID NO: 119211 - protein, 9 aa, Homo sapiens
  light chain complementarity determining region 3 for antibody 59606
QQFNNYPHT

SEQ ID NO: 119212 - protein, 11 aa, Homo sapiens
  heavy chain complementarity determining region 3 for antibody 59606
ARDGYSYYYDY

SEQ ID NO: 119213 - protein, 9 aa, Homo sapiens
  light chain complementarity determining region 3 for antibody 59607
QQFNNYPHT

SEQ ID NO: 119214 - protein, 11 aa, Homo sapiens
  heavy chain complementarity determining region 3 for antibody 59607
ARDGYSYYIDS

SEQ ID NO: 119215 - protein, 9 aa, Homo sapiens
  light chain complementarity determining region 3 for antibody 59608
QQFNNYPHT

SEQ ID NO: 119216 - protein, 11 aa, Homo sapiens
  heavy chain complementarity determining region 3 for antibody 59608
ARDGYSYAFDY

SEQ ID NO: 119217 - protein, 9 aa, Homo sapiens
  light chain complementarity determining region 3 for antibody 59609
QQFNNYPHT

SEQ ID NO: 119218 - protein, 11 aa, Homo sapiens
  heavy chain complementarity determining region 3 for antibody 59609
ARDGYSSYFAY

SEQ ID NO: 119219 - protein, 9 aa, Homo sapiens
  light chain complementarity determining region 3 for antibody 59610
QQFNNYPHT

SEQ ID NO: 119220 - protein, 11 aa, Homo sapiens
  heavy chain complementarity determining region 3 for antibody 59610
ARDGFSYDFDY

SEQ ID NO: 119221 - protein, 9 aa, Homo sapiens
  light chain complementarity determining region 3 for antibody 59611
QQFNNYPHT

SEQ ID NO: 119222 - protein, 11 aa, Homo sapiens
  heavy chain complementarity determining region 3 for antibody 59611
ARDAYSYSFDY

SEQ ID NO: 119223 - protein, 9 aa, Homo sapiens
  light chain complementarity determining region 3 for antibody 59612
QQFNNYPHT

SEQ ID NO: 119224 - protein, 11 aa, Homo sapiens
  heavy chain complementarity determining region 3 for antibody 59612
AGDGYSYYFDY

SEQ ID NO: 119225 - protein, 9 aa, Homo sapiens
  light chain complementarity determining region 3 for antibody 59613
QQFNNYAYT

SEQ ID NO: 119226 - protein, 15 aa, Homo sapiens
  heavy chain complementarity determining region 3 for antibody 59613
AREGFGESLHWFFDL

SEQ ID NO: 119227 - protein, 9 aa, Homo sapiens
  light chain complementarity determining region 3 for antibody 59614
QQDYNLPYT

SEQ ID NO: 119228 - protein, 9 aa, Homo sapiens
  heavy chain complementarity determining region 3 for antibody 59614
ARDRDVFDY

SEQ ID NO: 119229 - protein, 9 aa, Homo sapiens
  light chain complementarity determining region 3 for antibody 59615
QKYNSAPYT

SEQ ID NO: 119230 - protein, 17 aa, Homo sapiens
  heavy chain complementarity determining region 3 for antibody 59615
ARDKGIYSGSHYGAFDI

SEQ ID NO: 119231 - protein, 9 aa, Homo sapiens
  light chain complementarity determining region 3 for antibody 59616
QKYNSAPLT

SEQ ID NO: 119232 - protein, 12 aa, Homo sapiens
  heavy chain complementarity determining region 3 for antibody 59616
ARLWFGQGPFDY

SEQ ID NO: 119233 - protein, 9 aa, Homo sapiens
  light chain complementarity determining region 3 for antibody 59617
QKYDNLPYT

SEQ ID NO: 119234 - protein, 12 aa, Homo sapiens
  heavy chain complementarity determining region 3 for antibody 59617
ARAVAGYWYFDL

SEQ ID NO: 119235 - protein, 9 aa, Homo sapiens
  light chain complementarity determining region 3 for antibody 59618
PQDYNYPRT

SEQ ID NO: 119236 - protein, 11 aa, Homo sapiens
  heavy chain complementarity determining region 3 for antibody 59618
TRETLERGFDY

SEQ ID NO: 119237 - protein, 9 aa, Homo sapiens
  light chain complementarity determining region 3 for antibody 59619
LQYASSPFT

SEQ ID NO: 119238 - protein, 10 aa, Homo sapiens
  heavy chain complementarity determining region 3 for antibody 59619
ARDGYDGFDY

SEQ ID NO: 119239 - protein, 9 aa, Homo sapiens
  light chain complementarity determining region 3 for antibody 59620
LQHNSYPYT

SEQ ID NO: 119240 - protein, 12 aa, Homo sapiens
  heavy chain complementarity determining region 3 for antibody 59620
ARDVFLFFGESP

SEQ ID NO: 119241 - protein, 9 aa, Homo sapiens
  light chain complementarity determining region 3 for antibody 59621
LQHNSYPYT

SEQ ID NO: 119242 - protein, 15 aa, Homo sapiens
  heavy chain complementarity determining region 3 for antibody 59621
AGERGLWFVLEGMDV

SEQ ID NO: 119243 - protein, 9 aa, Homo sapiens
  light chain complementarity determining region 3 for antibody 59622
LQHNSYPYT

SEQ ID NO: 119244 - protein, 15 aa, Homo sapiens
  heavy chain complementarity determining region 3 for antibody 59622
AGERGLWFGPEGMDV

SEQ ID NO: 119245 - protein, 9 aa, Homo sapiens
  light chain complementarity determining region 3 for antibody 59623
LQHNSYPYT

SEQ ID NO: 119246 - protein, 15 aa, Homo sapiens
  heavy chain complementarity determining region 3 for antibody 59623
AGERALWFGLEGMDV

SEQ ID NO: 119247 - protein, 9 aa, Homo sapiens
  light chain complementarity determining region 3 for antibody 59624
LQHNSYPYT

SEQ ID NO: 119248 - protein, 15 aa, Homo sapiens
  heavy chain complementarity determining region 3 for antibody 59624
AGEGGLWFGLEGMDV

SEQ ID NO: 119249 - protein, 9 aa, Homo sapiens
  light chain complementarity determining region 3 for antibody 59625
LQHNSYPPT

SEQ ID NO: 119250 - protein, 17 aa, Homo sapiens
  heavy chain complementarity determining region 3 for antibody 59625
EREGNDILTGYYHAFDI

SEQ ID NO: 119251 - protein, 9 aa, Homo sapiens
  light chain complementarity determining region 3 for antibody 59626
LQHNSYPPT

SEQ ID NO: 119252 - protein, 17 aa, Homo sapiens
  heavy chain complementarity determining region 3 for antibody 59626
AREGNGILTGYYHAFDI

SEQ ID NO: 119253 - protein, 9 aa, Homo sapiens
  light chain complementarity determining region 3 for antibody 59627
LQHNSYPPT

SEQ ID NO: 119254 - protein, 17 aa, Homo sapiens
  heavy chain complementarity determining region 3 for antibody 59627
AREGNDTLTGYYHAFDI

SEQ ID NO: 119255 - protein, 9 aa, Homo sapiens
  light chain complementarity determining region 3 for antibody 59628
LQHNSYPPT

SEQ ID NO: 119256 - protein, 17 aa, Homo sapiens
  heavy chain complementarity determining region 3 for antibody 59628
AREGNDIWAGYYHAFDI

SEQ ID NO: 119257 - protein, 9 aa, Homo sapiens
  light chain complementarity determining region 3 for antibody 59629
LQHNSYPPT

SEQ ID NO: 119258 - protein, 17 aa, Homo sapiens
  heavy chain complementarity determining region 3 for antibody 59629
AREGNDILTGYYHSFDI

SEQ ID NO: 119259 - protein, 9 aa, Homo sapiens
  light chain complementarity determining region 3 for antibody 59630
LQHNSYPPT

SEQ ID NO: 119260 - protein, 17 aa, Homo sapiens
  heavy chain complementarity determining region 3 for antibody 59630
AREGNDILTGYYHAFAI

SEQ ID NO: 119261 - protein, 9 aa, Homo sapiens
  light chain complementarity determining region 3 for antibody 59631
LQHNSYPPT

SEQ ID NO: 119262 - protein, 17 aa, Homo sapiens
  heavy chain complementarity determining region 3 for antibody 59631
AREGNDILTGYHHAFDI

SEQ ID NO: 119263 - protein, 9 aa, Homo sapiens
  light chain complementarity determining region 3 for antibody 59632
LQHNSYPPT

SEQ ID NO: 119264 - protein, 17 aa, Homo sapiens
  heavy chain complementarity determining region 3 for antibody 59632
AREGNDILTAYYHAFDI

SEQ ID NO: 119265 - protein, 9 aa, Homo sapiens
  light chain complementarity determining region 3 for antibody 59633
LQHNSYPPT

SEQ ID NO: 119266 - protein, 17 aa, Homo sapiens
  heavy chain complementarity determining region 3 for antibody 59633
AGEGNDILAGYYHAFDI

SEQ ID NO: 119267 - protein, 9 aa, Homo sapiens
  light chain complementarity determining region 3 for antibody 59634
LQHNSYPLT

SEQ ID NO: 119268 - protein, 15 aa, Homo sapiens
  heavy chain complementarity determining region 3 for antibody 59634
ARGGSGEFYYYGMDV

SEQ ID NO: 119269 - protein, 9 aa, Homo sapiens
  light chain complementarity determining region 3 for antibody 59635
LQHNSYPLT

SEQ ID NO: 119270 - protein, 15 aa, Homo sapiens
  heavy chain complementarity determining region 3 for antibody 59635
ARGGCGEFYYYGMDV

SEQ ID NO: 119271 - protein, 9 aa, Homo sapiens
  light chain complementarity determining region 3 for antibody 59636
LQHNNYPYT

SEQ ID NO: 119272 - protein, 12 aa, Homo sapiens
  heavy chain complementarity determining region 3 for antibody 59636
ASDVFLFFGEFP

SEQ ID NO: 119273 - protein, 9 aa, Homo sapiens
  light chain complementarity determining region 3 for antibody 59637
LQHNNYPYT

SEQ ID NO: 119274 - protein, 12 aa, Homo sapiens
  heavy chain complementarity determining region 3 for antibody 59637
ARDVFLFYGEFP

SEQ ID NO: 119275 - protein, 9 aa, Homo sapiens
  light chain complementarity determining region 3 for antibody 59638
LQHNNYPYT

SEQ ID NO: 119276 - protein, 12 aa, Homo sapiens
  heavy chain complementarity determining region 3 for antibody 59638
ARDVFLFFGKSP

SEQ ID NO: 119277 - protein, 9 aa, Homo sapiens
  light chain complementarity determining region 3 for antibody 59639
LQHNNYPYT

SEQ ID NO: 119278 - protein, 12 aa, Homo sapiens
  heavy chain complementarity determining region 3 for antibody 59639
ARDVFLFFGESL

SEQ ID NO: 119279 - protein, 9 aa, Homo sapiens
  light chain complementarity determining region 3 for antibody 59640
LQHNNYPYT

SEQ ID NO: 119280 - protein, 12 aa, Homo sapiens
  heavy chain complementarity determining region 3 for antibody 59640
ARDVFLFFGEHP

SEQ ID NO: 119281 - protein, 9 aa, Homo sapiens
  light chain complementarity determining region 3 for antibody 59641
LQHNNYPYT

SEQ ID NO: 119282 - protein, 12 aa, Homo sapiens
  heavy chain complementarity determining region 3 for antibody 59641
ARDVCLFFGESP

SEQ ID NO: 119283 - protein, 9 aa, Homo sapiens
  light chain complementarity determining region 3 for antibody 59642
LQHNGYPPT

SEQ ID NO: 119284 - protein, 17 aa, Homo sapiens
  heavy chain complementarity determining region 3 for antibody 59642
AREGNDILTGYYHAFDI

SEQ ID NO: 119285 - protein, 9 aa, Homo sapiens
  light chain complementarity determining region 3 for antibody 59643
LQDYNYPYT

SEQ ID NO: 119286 - protein, 13 aa, Homo sapiens
  heavy chain complementarity determining region 3 for antibody 59643
ARDRYFDWLALDY

SEQ ID NO: 119287 - protein, 9 aa, Homo sapiens
  light chain complementarity determining region 3 for antibody 59644
LQDYNYPYT

SEQ ID NO: 119288 - protein, 13 aa, Homo sapiens
  heavy chain complementarity determining region 3 for antibody 59644
AGDRYFDWLSLDY

SEQ ID NO: 119289 - protein, 9 aa, Homo sapiens
  light chain complementarity determining region 3 for antibody 59645
LQDYNYPWT

SEQ ID NO: 119290 - protein, 11 aa, Homo sapiens
  heavy chain complementarity determining region 3 for antibody 59645
AREGALYGMAV

SEQ ID NO: 119291 - protein, 9 aa, Homo sapiens
  light chain complementarity determining region 3 for antibody 59646
LQDYNYPWT

SEQ ID NO: 119292 - protein, 21 aa, Homo sapiens
  heavy chain complementarity determining region 3 for antibody 59646
ARDGRDYGSGSHYYSYYGMDV

SEQ ID NO: 119293 - protein, 9 aa, Homo sapiens
  light chain complementarity determining region 3 for antibody 59647
LQDYNYPWT

SEQ ID NO: 119294 - protein, 21 aa, Homo sapiens
  heavy chain complementarity determining region 3 for antibody 59647
ARDGGDYGSGSHYYYSYGMDV

SEQ ID NO: 119295 - protein, 9 aa, Homo sapiens
  light chain complementarity determining region 3 for antibody 59648
LQDYNYPRT

SEQ ID NO: 119296 - protein, 11 aa, Homo sapiens
  heavy chain complementarity determining region 3 for antibody 59648
TRETVERGIDY

SEQ ID NO: 119297 - protein, 9 aa, Homo sapiens
  light chain complementarity determining region 3 for antibody 59649
LQDYNYPRT

SEQ ID NO: 119298 - protein, 11 aa, Homo sapiens
  heavy chain complementarity determining region 3 for antibody 59649
TRETLYRGFAY

SEQ ID NO: 119299 - protein, 9 aa, Homo sapiens
  light chain complementarity determining region 3 for antibody 59650
LQDYNYPRT

SEQ ID NO: 119300 - protein, 11 aa, Homo sapiens
  heavy chain complementarity determining region 3 for antibody 59650
TRETLYQGFDY

SEQ ID NO: 119301 - protein, 9 aa, Homo sapiens
  light chain complementarity determining region 3 for antibody 59651
LQDYNYPRT

SEQ ID NO: 119302 - protein, 11 aa, Homo sapiens
  heavy chain complementarity determining region 3 for antibody 59651
TRETLDRVFDY

SEQ ID NO: 119303 - protein, 9 aa, Homo sapiens
  light chain complementarity determining region 3 for antibody 59652
LQDYNYPRT

SEQ ID NO: 119304 - protein, 11 aa, Homo sapiens
  heavy chain complementarity determining region 3 for antibody 59652
TRETLDRGFAS

SEQ ID NO: 119305 - protein, 9 aa, Homo sapiens
  light chain complementarity determining region 3 for antibody 59653
LQDYNYPRT

SEQ ID NO: 119306 - protein, 11 aa, Homo sapiens
  heavy chain complementarity determining region 3 for antibody 59653
TRETLDRGCDY

SEQ ID NO: 119307 - protein, 9 aa, Homo sapiens
  light chain complementarity determining region 3 for antibody 59654
LQDYNYPRT

SEQ ID NO: 119308 - protein, 11 aa, Homo sapiens
  heavy chain complementarity determining region 3 for antibody 59654
TRETLARGLDY

SEQ ID NO: 119309 - protein, 9 aa, Homo sapiens
  light chain complementarity determining region 3 for antibody 59655
LQDYNYPRT

SEQ ID NO: 119310 - protein, 11 aa, Homo sapiens
  heavy chain complementarity determining region 3 for antibody 59655
TRDTLYRGIDY

SEQ ID NO: 119311 - protein, 9 aa, Homo sapiens
  light chain complementarity determining region 3 for antibody 59656
LQDYNYPRT

SEQ ID NO: 119312 - protein, 11 aa, Homo sapiens
  heavy chain complementarity determining region 3 for antibody 59656
TRDTLYRGFDS

SEQ ID NO: 119313 - protein, 9 aa, Homo sapiens
  light chain complementarity determining region 3 for antibody 59657
LQDYNYPRT

SEQ ID NO: 119314 - protein, 11 aa, Homo sapiens
  heavy chain complementarity determining region 3 for antibody 59657
TRDTLEPGFDY

SEQ ID NO: 119315 - protein, 9 aa, Homo sapiens
  light chain complementarity determining region 3 for antibody 59658
LQDYNYPRT

SEQ ID NO: 119316 - protein, 11 aa, Homo sapiens
  heavy chain complementarity determining region 3 for antibody 59658
TRDTLDRGIDY

SEQ ID NO: 119317 - protein, 9 aa, Homo sapiens
  light chain complementarity determining region 3 for antibody 59659
LQDYNYPRT

SEQ ID NO: 119318 - protein, 11 aa, Homo sapiens
  heavy chain complementarity determining region 3 for antibody 59659
TRATLDRGFDY

SEQ ID NO: 119319 - protein, 9 aa, Homo sapiens
  light chain complementarity determining region 3 for antibody 59660
LQDYNYPRT

SEQ ID NO: 119320 - protein, 11 aa, Homo sapiens
  heavy chain complementarity determining region 3 for antibody 59660
ARETLDRGFDY

SEQ ID NO: 119321 - protein, 9 aa, Homo sapiens
  light chain complementarity determining region 3 for antibody 59661
LQDYNYPRT

SEQ ID NO: 119322 - protein, 12 aa, Homo sapiens
  heavy chain complementarity determining region 3 for antibody 59661
ARAVAGYWYFDL

SEQ ID NO: 119323 - protein, 9 aa, Homo sapiens
  light chain complementarity determining region 3 for antibody 59662
LQDYNYPRS

SEQ ID NO: 119324 - protein, 11 aa, Homo sapiens
  heavy chain complementarity determining region 3 for antibody 59662
TRETLERGFDY

SEQ ID NO: 119325 - protein, 9 aa, Homo sapiens
  light chain complementarity determining region 3 for antibody 59663
LQDYNYPRM

SEQ ID NO: 119326 - protein, 11 aa, Homo sapiens
  heavy chain complementarity determining region 3 for antibody 59663
TRETLERGFDY

SEQ ID NO: 119327 - protein, 9 aa, Homo sapiens
  light chain complementarity determining region 3 for antibody 59664
LQDYNYPLT

SEQ ID NO: 119328 - protein, 11 aa, Homo sapiens
  heavy chain complementarity determining region 3 for antibody 59664
TRETLERGFDY

SEQ ID NO: 119329 - protein, 9 aa, Homo sapiens
  light chain complementarity determining region 3 for antibody 59665
LQDYNYPCT

SEQ ID NO: 119330 - protein, 11 aa, Homo sapiens
  heavy chain complementarity determining region 3 for antibody 59665
AREGALYGMDV

SEQ ID NO: 119331 - protein, 9 aa, Homo sapiens
  light chain complementarity determining region 3 for antibody 59666
LQDYNYHRT

SEQ ID NO: 119332 - protein, 11 aa, Homo sapiens
  heavy chain complementarity determining region 3 for antibody 59666
TRETLERGFDY

SEQ ID NO: 119333 - protein, 9 aa, Homo sapiens
  light chain complementarity determining region 3 for antibody 59667
LQDYNHPRT

SEQ ID NO: 119334 - protein, 11 aa, Homo sapiens
  heavy chain complementarity determining region 3 for antibody 59667
TRETLARGFDY

SEQ ID NO: 119335 - protein, 9 aa, Homo sapiens
  light chain complementarity determining region 3 for antibody 59668
LQDYIYPWT

SEQ ID NO: 119336 - protein, 11 aa, Homo sapiens
  heavy chain complementarity determining region 3 for antibody 59668
ARYGAVAGLDY

SEQ ID NO: 119337 - protein, 9 aa, Homo sapiens
  light chain complementarity determining region 3 for antibody 59669
LQDYIYPWT

SEQ ID NO: 119338 - protein, 11 aa, Homo sapiens
  heavy chain complementarity determining region 3 for antibody 59669
ARDGSVAGLDY

SEQ ID NO: 119339 - protein, 9 aa, Homo sapiens
  light chain complementarity determining region 3 for antibody 59670
LQDYIYPWT

SEQ ID NO: 119340 - protein, 11 aa, Homo sapiens
  heavy chain complementarity determining region 3 for antibody 59670
ARDGAVSGLDY

SEQ ID NO: 119341 - protein, 9 aa, Homo sapiens
  light chain complementarity determining region 3 for antibody 59671
LQDYIYPWT

SEQ ID NO: 119342 - protein, 11 aa, Homo sapiens
  heavy chain complementarity determining region 3 for antibody 59671
ARDGAVAGLAY

SEQ ID NO: 119343 - protein, 9 aa, Homo sapiens
  light chain complementarity determining region 3 for antibody 59672
LQDYIYPWT

SEQ ID NO: 119344 - protein, 11 aa, Homo sapiens
  heavy chain complementarity determining region 3 for antibody 59672
ARDGALAGLDY

SEQ ID NO: 119345 - protein, 9 aa, Homo sapiens
  light chain complementarity determining region 3 for antibody 59673
LQDYIYPWT

SEQ ID NO: 119346 - protein, 11 aa, Homo sapiens
  heavy chain complementarity determining region 3 for antibody 59673
ARDAAVAGLDY

SEQ ID NO: 119347 - protein, 9 aa, Homo sapiens
  light chain complementarity determining region 3 for antibody 59674
LQDYDYPFT

SEQ ID NO: 119348 - protein, 14 aa, Homo sapiens
  heavy chain complementarity determining region 3 for antibody 59674
AREGLWFGENCFDP

SEQ ID NO: 119349 - protein, 9 aa, Homo sapiens
  light chain complementarity determining region 3 for antibody 59675
IQDYNYPRT

SEQ ID NO: 119350 - protein, 11 aa, Homo sapiens
  heavy chain complementarity determining region 3 for antibody 59675
TRDTLERGFDY

SEQ ID NO: 119351 - protein, 9 aa, Homo sapiens
  light chain complementarity determining region 3 for antibody 59676
HQYHRSPRT

SEQ ID NO: 119352 - protein, 10 aa, Homo sapiens
  heavy chain complementarity determining region 3 for antibody 59676
ARDRAYYFDY

SEQ ID NO: 119353 - protein, 9 aa, Homo sapiens
  light chain complementarity determining region 3 for antibody 59677
HQTSSLPLT

SEQ ID NO: 119354 - protein, 9 aa, Homo sapiens
  heavy chain complementarity determining region 3 for antibody 59677
ASDTSAADY

SEQ ID NO: 119355 - protein, 9 aa, Homo sapiens
  light chain complementarity determining region 3 for antibody 59678
HQTSSLPLT

SEQ ID NO: 119356 - protein, 9 aa, Homo sapiens
  heavy chain complementarity determining region 3 for antibody 59678
ARDTSADDY

SEQ ID NO: 119357 - protein, 9 aa, Homo sapiens
  light chain complementarity determining region 3 for antibody 59679
HQTSSLPLT

SEQ ID NO: 119358 - protein, 9 aa, Homo sapiens
  heavy chain complementarity determining region 3 for antibody 59679
ARDISAADS

SEQ ID NO: 119359 - protein, 9 aa, Homo sapiens
  light chain complementarity determining region 3 for antibody 59680
HQTSGLPLT

SEQ ID NO: 119360 - protein, 9 aa, Homo sapiens
  heavy chain complementarity determining region 3 for antibody 59680
ARDISADDY

SEQ ID NO: 119361 - protein, 9 aa, Homo sapiens
  light chain complementarity determining region 3 for antibody 59681
HQSSSLPWT

SEQ ID NO: 119362 - protein, 16 aa, Homo sapiens
  heavy chain complementarity determining region 3 for antibody 59681
ATDRYYYGAGSYPFDK

SEQ ID NO: 119363 - protein, 9 aa, Homo sapiens
  light chain complementarity determining region 3 for antibody 59682
HQSSSLPWT

SEQ ID NO: 119364 - protein, 16 aa, Homo sapiens
  heavy chain complementarity determining region 3 for antibody 59682
AADRDYYGSGSYPFDK

SEQ ID NO: 119365 - protein, 9 aa, Homo sapiens
  light chain complementarity determining region 3 for antibody 59683
HQSSSLPHT

SEQ ID NO: 119366 - protein, 13 aa, Homo sapiens
  heavy chain complementarity determining region 3 for antibody 59683
ASDYGDYVGAFDI

SEQ ID NO: 119367 - protein, 9 aa, Homo sapiens
  light chain complementarity determining region 3 for antibody 59684
RQYNSYPRT

SEQ ID NO: 119368 - protein, 17 aa, Homo sapiens
  heavy chain complementarity determining region 3 for antibody 59684
STAPVGTTLYYYYGMDV

SEQ ID NO: 119369 - protein, 9 aa, Homo sapiens
  light chain complementarity determining region 3 for antibody 59685
QQYNSYSRT

SEQ ID NO: 119370 - protein, 17 aa, Homo sapiens
  heavy chain complementarity determining region 3 for antibody 59685
STAPVGTTLSYYYGMDV

SEQ ID NO: 119371 - protein, 9 aa, Homo sapiens
  light chain complementarity determining region 3 for antibody 59686
QQYNSYSRT

SEQ ID NO: 119372 - protein, 17 aa, Homo sapiens
  heavy chain complementarity determining region 3 for antibody 59686
SAAPVGTTLSYYYGMDV

SEQ ID NO: 119373 - protein, 9 aa, Homo sapiens
  light chain complementarity determining region 3 for antibody 59687
QQYNSYPYT

SEQ ID NO: 119374 - protein, 20 aa, Homo sapiens
  heavy chain complementarity determining region 3 for antibody 59687
EREGVAAVGRVYYFYYGMDV

SEQ ID NO: 119375 - protein, 9 aa, Homo sapiens
  light chain complementarity determining region 3 for antibody 59688
QQYNSYPYT

SEQ ID NO: 119376 - protein, 15 aa, Homo sapiens
  heavy chain complementarity determining region 3 for antibody 59688
ASGRRCGESYYGMDV

SEQ ID NO: 119377 - protein, 9 aa, Homo sapiens
  light chain complementarity determining region 3 for antibody 59689
QQYNSYPYT

SEQ ID NO: 119378 - protein, 13 aa, Homo sapiens
  heavy chain complementarity determining region 3 for antibody 59689
ASEYGDYVGAFDI

SEQ ID NO: 119379 - protein, 9 aa, Homo sapiens
  light chain complementarity determining region 3 for antibody 59690
QQYNSYPYT

SEQ ID NO: 119380 - protein, 13 aa, Homo sapiens
  heavy chain complementarity determining region 3 for antibody 59690
ASDYGAYVGAFDI

SEQ ID NO: 119381 - protein, 9 aa, Homo sapiens
  light chain complementarity determining region 3 for antibody 59691
QQYNSYPYT

SEQ ID NO: 119382 - protein, 12 aa, Homo sapiens
  heavy chain complementarity determining region 3 for antibody 59691
ARVIWVWSPFDD

SEQ ID NO: 119383 - protein, 9 aa, Homo sapiens
  light chain complementarity determining region 3 for antibody 59692
QQYNSYPYT

SEQ ID NO: 119384 - protein, 12 aa, Homo sapiens
  heavy chain complementarity determining region 3 for antibody 59692
ARVIGVWSPLDD

SEQ ID NO: 119385 - protein, 9 aa, Homo sapiens
  light chain complementarity determining region 3 for antibody 59693
QQYNSYPYT

SEQ ID NO: 119386 - protein, 12 aa, Homo sapiens
  heavy chain complementarity determining region 3 for antibody 59693
ARVIGVWSPCDD

SEQ ID NO: 119387 - protein, 9 aa, Homo sapiens
  light chain complementarity determining region 3 for antibody 59694
QQYNSYPYT

SEQ ID NO: 119388 - protein, 12 aa, Homo sapiens
  heavy chain complementarity determining region 3 for antibody 59694
ARVIGVSSPFDD

SEQ ID NO: 119389 - protein, 9 aa, Homo sapiens
  light chain complementarity determining region 3 for antibody 59695
QQYNSYPYT

SEQ ID NO: 119390 - protein, 12 aa, Homo sapiens
  heavy chain complementarity determining region 3 for antibody 59695
ARVIGLWSPFDD

SEQ ID NO: 119391 - protein, 9 aa, Homo sapiens
  light chain complementarity determining region 3 for antibody 59696
QQYNSYPYT

SEQ ID NO: 119392 - protein, 12 aa, Homo sapiens
  heavy chain complementarity determining region 3 for antibody 59696
ARVIEVWSPFDD

SEQ ID NO: 119393 - protein, 9 aa, Homo sapiens
  light chain complementarity determining region 3 for antibody 59697
QQYNSYPYT

SEQ ID NO: 119394 - protein, 12 aa, Homo sapiens
  heavy chain complementarity determining region 3 for antibody 59697
ARGIGVWSPFDD

SEQ ID NO: 119395 - protein, 9 aa, Homo sapiens
  light chain complementarity determining region 3 for antibody 59698
QQYNSYPYT

SEQ ID NO: 119396 - protein, 13 aa, Homo sapiens
  heavy chain complementarity determining region 3 for antibody 59698
ARERWEPGVYCDY

SEQ ID NO: 119397 - protein, 9 aa, Homo sapiens
  light chain complementarity determining region 3 for antibody 59699
QQYNSYPYT

SEQ ID NO: 119398 - protein, 20 aa, Homo sapiens
  heavy chain complementarity determining region 3 for antibody 59699
AREGVAGVGRVYYFYYGMDV

SEQ ID NO: 119399 - protein, 9 aa, Homo sapiens
  light chain complementarity determining region 3 for antibody 59700
QQYNSYPYT

SEQ ID NO: 119400 - protein, 20 aa, Homo sapiens
  heavy chain complementarity determining region 3 for antibody 59700
AREGVAAVGRVYYFYYGIDV

SEQ ID NO: 119401 - protein, 9 aa, Homo sapiens
  light chain complementarity determining region 3 for antibody 59701
QQYNSYPYT

SEQ ID NO: 119402 - protein, 20 aa, Homo sapiens
  heavy chain complementarity determining region 3 for antibody 59701
AREGVAAVGRVDYFYYGMDV

SEQ ID NO: 119403 - protein, 9 aa, Homo sapiens
  light chain complementarity determining region 3 for antibody 59702
QQYNSYPYT

SEQ ID NO: 119404 - protein, 20 aa, Homo sapiens
  heavy chain complementarity determining region 3 for antibody 59702
AREGVAAVGRVCYFYYGMDV

SEQ ID NO: 119405 - protein, 9 aa, Homo sapiens
  light chain complementarity determining region 3 for antibody 59703
QQYNSYPYT

SEQ ID NO: 119406 - protein, 20 aa, Homo sapiens
  heavy chain complementarity determining region 3 for antibody 59703
AREGVAAVGKVYYFYYGMDV

SEQ ID NO: 119407 - protein, 9 aa, Homo sapiens
  light chain complementarity determining region 3 for antibody 59704
QQYNSYPYT

SEQ ID NO: 119408 - protein, 20 aa, Homo sapiens
  heavy chain complementarity determining region 3 for antibody 59704
AREGVAADGRVYYFYYGMDV

SEQ ID NO: 119409 - protein, 9 aa, Homo sapiens
  light chain complementarity determining region 3 for antibody 59705
QQYNSYPYT

SEQ ID NO: 119410 - protein, 13 aa, Homo sapiens
  heavy chain complementarity determining region 3 for antibody 59705
AGDYGDYVGAFDI

SEQ ID NO: 119411 - protein, 9 aa, Homo sapiens
  light chain complementarity determining region 3 for antibody 59706
QQYNSYPYT

SEQ ID NO: 119412 - protein, 15 aa, Homo sapiens
  heavy chain complementarity determining region 3 for antibody 59706
AAGRRFGESYYGMDV

SEQ ID NO: 119413 - protein, 9 aa, Homo sapiens
  light chain complementarity determining region 3 for antibody 59707
QQYNSYPRT

SEQ ID NO: 119414 - protein, 17 aa, Homo sapiens
  heavy chain complementarity determining region 3 for antibody 59707
YTAPVGTTLYSYYGMDV

SEQ ID NO: 119415 - protein, 9 aa, Homo sapiens
  light chain complementarity determining region 3 for antibody 59708
QQYNSYPRT

SEQ ID NO: 119416 - protein, 17 aa, Homo sapiens
  heavy chain complementarity determining region 3 for antibody 59708
YAAPVGTTLYYYYGMDV

SEQ ID NO: 119417 - protein, 9 aa, Homo sapiens
  light chain complementarity determining region 3 for antibody 59709
QQYNSYPRT

SEQ ID NO: 119418 - protein, 17 aa, Homo sapiens
  heavy chain complementarity determining region 3 for antibody 59709
STGPVGTTLYYYYGMDV

SEQ ID NO: 119419 - protein, 9 aa, Homo sapiens
  light chain complementarity determining region 3 for antibody 59710
QQYNSYPRT

SEQ ID NO: 119420 - protein, 17 aa, Homo sapiens
  heavy chain complementarity determining region 3 for antibody 59710
STAPVGTTLYYYDGMDV

SEQ ID NO: 119421 - protein, 9 aa, Homo sapiens
  light chain complementarity determining region 3 for antibody 59711
QQYNSYPRT

SEQ ID NO: 119422 - protein, 17 aa, Homo sapiens
  heavy chain complementarity determining region 3 for antibody 59711
STAPVGTTLYSSYGMDV

SEQ ID NO: 119423 - protein, 9 aa, Homo sapiens
  light chain complementarity determining region 3 for antibody 59712
QQYNSYPRT

SEQ ID NO: 119424 - protein, 17 aa, Homo sapiens
  heavy chain complementarity determining region 3 for antibody 59712
STAPVGTTLYFSYGMDV

SEQ ID NO: 119425 - protein, 9 aa, Homo sapiens
  light chain complementarity determining region 3 for antibody 59713
QQYNSYPRT

SEQ ID NO: 119426 - protein, 17 aa, Homo sapiens
  heavy chain complementarity determining region 3 for antibody 59713
STAPVGTTLSYYYAMDV

SEQ ID NO: 119427 - protein, 9 aa, Homo sapiens
  light chain complementarity determining region 3 for antibody 59714
QQYNSYPRT

SEQ ID NO: 119428 - protein, 17 aa, Homo sapiens
  heavy chain complementarity determining region 3 for antibody 59714
STAPVGTTLDYYYGMDV

SEQ ID NO: 119429 - protein, 9 aa, Homo sapiens
  light chain complementarity determining region 3 for antibody 59715
QQYNSYPRT

SEQ ID NO: 119430 - protein, 17 aa, Homo sapiens
  heavy chain complementarity determining region 3 for antibody 59715
STAPVGTTLDSYYGMDV

SEQ ID NO: 119431 - protein, 9 aa, Homo sapiens
  light chain complementarity determining region 3 for antibody 59716
QQYNSYPRT

SEQ ID NO: 119432 - protein, 17 aa, Homo sapiens
  heavy chain complementarity determining region 3 for antibody 59716
STAPVGTTLCYYCGMDV

SEQ ID NO: 119433 - protein, 9 aa, Homo sapiens
  light chain complementarity determining region 3 for antibody 59717
QQYNSYPRT

SEQ ID NO: 119434 - protein, 17 aa, Homo sapiens
  heavy chain complementarity determining region 3 for antibody 59717
SAGPVGTTLYYSYGMDV

SEQ ID NO: 119435 - protein, 9 aa, Homo sapiens
  light chain complementarity determining region 3 for antibody 59718
QQYNSYPRT

SEQ ID NO: 119436 - protein, 17 aa, Homo sapiens
  heavy chain complementarity determining region 3 for antibody 59718
SAAPVGTTLYYYYGMDD

SEQ ID NO: 119437 - protein, 9 aa, Homo sapiens
  light chain complementarity determining region 3 for antibody 59719
QQYNSYPRT

SEQ ID NO: 119438 - protein, 17 aa, Homo sapiens
  heavy chain complementarity determining region 3 for antibody 59719
SAAPVGTTLYYYYGIDV

SEQ ID NO: 119439 - protein, 9 aa, Homo sapiens
  light chain complementarity determining region 3 for antibody 59720
QQYNSYPRT

SEQ ID NO: 119440 - protein, 17 aa, Homo sapiens
  heavy chain complementarity determining region 3 for antibody 59720
SAAPVGTTLYFYYGMDA

SEQ ID NO: 119441 - protein, 9 aa, Homo sapiens
  light chain complementarity determining region 3 for antibody 59721
QQYNSYPRT

SEQ ID NO: 119442 - protein, 17 aa, Homo sapiens
  heavy chain complementarity determining region 3 for antibody 59721
SAAPVGTTLYFSYGMDV

SEQ ID NO: 119443 - protein, 9 aa, Homo sapiens
  light chain complementarity determining region 3 for antibody 59722
QQYNSYPRT

SEQ ID NO: 119444 - protein, 17 aa, Homo sapiens
  heavy chain complementarity determining region 3 for antibody 59722
SAAPVGTTLDYYYGMDV

SEQ ID NO: 119445 - protein, 9 aa, Homo sapiens
  light chain complementarity determining region 3 for antibody 59723
QQYNSYPRT

SEQ ID NO: 119446 - protein, 17 aa, Homo sapiens
  heavy chain complementarity determining region 3 for antibody 59723
SAAPVGTTLCYYYGMDV

SEQ ID NO: 119447 - protein, 9 aa, Homo sapiens
  light chain complementarity determining region 3 for antibody 59724
QQYNSYPRT

SEQ ID NO: 119448 - protein, 17 aa, Homo sapiens
  heavy chain complementarity determining region 3 for antibody 59724
SAAPVGTNLYYYYGMDV

SEQ ID NO: 119449 - protein, 9 aa, Homo sapiens
  light chain complementarity determining region 3 for antibody 59725
QQYNSYPRT

SEQ ID NO: 119450 - protein, 17 aa, Homo sapiens
  heavy chain complementarity determining region 3 for antibody 59725
SAAAVGTTLSYYYGMDV

SEQ ID NO: 119451 - protein, 9 aa, Homo sapiens
  light chain complementarity determining region 3 for antibody 59726
QQYNSYPRT

SEQ ID NO: 119452 - protein, 17 aa, Homo sapiens
  heavy chain complementarity determining region 3 for antibody 59726
ATAPVGTTLYYYYGMDA

SEQ ID NO: 119453 - protein, 9 aa, Homo sapiens
  light chain complementarity determining region 3 for antibody 59727
QQYNSYPRT

SEQ ID NO: 119454 - protein, 17 aa, Homo sapiens
  heavy chain complementarity determining region 3 for antibody 59727
ATAPVGTTLYYYSAMDV

SEQ ID NO: 119455 - protein, 9 aa, Homo sapiens
  light chain complementarity determining region 3 for antibody 59728
QQYNSYPRT

SEQ ID NO: 119456 - protein, 17 aa, Homo sapiens
  heavy chain complementarity determining region 3 for antibody 59728
ATAPVGTTLYSYYGMDV

SEQ ID NO: 119457 - protein, 9 aa, Homo sapiens
  light chain complementarity determining region 3 for antibody 59729
QQYNSYPRT

SEQ ID NO: 119458 - protein, 17 aa, Homo sapiens
  heavy chain complementarity determining region 3 for antibody 59729
ATAPVGTTLYFYYGMDV

SEQ ID NO: 119459 - protein, 9 aa, Homo sapiens
  light chain complementarity determining region 3 for antibody 59730
QQYNSYPRT

SEQ ID NO: 119460 - protein, 17 aa, Homo sapiens
  heavy chain complementarity determining region 3 for antibody 59730
ATAPVGTTLTYYYGMDV

SEQ ID NO: 119461 - protein, 9 aa, Homo sapiens
  light chain complementarity determining region 3 for antibody 59731
QQYNSYPRT

SEQ ID NO: 119462 - protein, 17 aa, Homo sapiens
  heavy chain complementarity determining region 3 for antibody 59731
ATAPVGTNLYYYYGMDV

SEQ ID NO: 119463 - protein, 9 aa, Homo sapiens
  light chain complementarity determining region 3 for antibody 59732
QQYNSYPRT

SEQ ID NO: 119464 - protein, 17 aa, Homo sapiens
  heavy chain complementarity determining region 3 for antibody 59732
ATAPVGTNLSYYYGMDV

SEQ ID NO: 119465 - protein, 9 aa, Homo sapiens
  light chain complementarity determining region 3 for antibody 59733
QQYNSYPRT

SEQ ID NO: 119466 - protein, 17 aa, Homo sapiens
  heavy chain complementarity determining region 3 for antibody 59733
ATAPEGTTLYYYYGMDV

SEQ ID NO: 119467 - protein, 9 aa, Homo sapiens
  light chain complementarity determining region 3 for antibody 59734
QQYNSYPRT

SEQ ID NO: 119468 - protein, 17 aa, Homo sapiens
  heavy chain complementarity determining region 3 for antibody 59734
ATAPEGTTLSYYYGMDV

SEQ ID NO: 119469 - protein, 9 aa, Homo sapiens
  light chain complementarity determining region 3 for antibody 59735
QQYNSYPRT

SEQ ID NO: 119470 - protein, 17 aa, Homo sapiens
  heavy chain complementarity determining region 3 for antibody 59735
ATAAVGTTLYYSYGMDV

SEQ ID NO: 119471 - protein, 9 aa, Homo sapiens
  light chain complementarity determining region 3 for antibody 59736
QQYNSYPRT

SEQ ID NO: 119472 - protein, 9 aa, Homo sapiens
  heavy chain complementarity determining region 3 for antibody 59736
ARDPSGSDY

SEQ ID NO: 119473 - protein, 9 aa, Homo sapiens
  light chain complementarity determining region 3 for antibody 59737
QQYNSYPRT

SEQ ID NO: 119474 - protein, 9 aa, Homo sapiens
  heavy chain complementarity determining region 3 for antibody 59737
ARDLSGYDY

SEQ ID NO: 119475 - protein, 9 aa, Homo sapiens
  light chain complementarity determining region 3 for antibody 59738
QQYNSYPRT

SEQ ID NO: 119476 - protein, 17 aa, Homo sapiens
  heavy chain complementarity determining region 3 for antibody 59738
AAAPVGTTLYYSYGMDV

SEQ ID NO: 119477 - protein, 9 aa, Homo sapiens
  light chain complementarity determining region 3 for antibody 59739
QQYNSYPRT

SEQ ID NO: 119478 - protein, 17 aa, Homo sapiens
  heavy chain complementarity determining region 3 for antibody 59739
AAAPVGTTLYFYYGMDV

SEQ ID NO: 119479 - protein, 9 aa, Homo sapiens
  light chain complementarity determining region 3 for antibody 59740
QQYNSYPPT

SEQ ID NO: 119480 - protein, 12 aa, Homo sapiens
  heavy chain complementarity determining region 3 for antibody 59740
GRELEQQLVFDY

SEQ ID NO: 119481 - protein, 9 aa, Homo sapiens
  light chain complementarity determining region 3 for antibody 59741
QQYNSYPPT

SEQ ID NO: 119482 - protein, 12 aa, Homo sapiens
  heavy chain complementarity determining region 3 for antibody 59741
ATELAQQLVFDY

SEQ ID NO: 119483 - protein, 9 aa, Homo sapiens
  light chain complementarity determining region 3 for antibody 59742
QQYNSYPPT

SEQ ID NO: 119484 - protein, 12 aa, Homo sapiens
  heavy chain complementarity determining region 3 for antibody 59742
ASEVEQQLVFDY

SEQ ID NO: 119485 - protein, 9 aa, Homo sapiens
  light chain complementarity determining region 3 for antibody 59743
QQYNSYPPT

SEQ ID NO: 119486 - protein, 12 aa, Homo sapiens
  heavy chain complementarity determining region 3 for antibody 59743
ASEFEQHLVFDY

SEQ ID NO: 119487 - protein, 9 aa, Homo sapiens
  light chain complementarity determining region 3 for antibody 59744
QQYNSYPPT

SEQ ID NO: 119488 - protein, 12 aa, Homo sapiens
  heavy chain complementarity determining region 3 for antibody 59744
ARQLEQQLVFDY

SEQ ID NO: 119489 - protein, 9 aa, Homo sapiens
  light chain complementarity determining region 3 for antibody 59745
QQYNSYPPT

SEQ ID NO: 119490 - protein, 12 aa, Homo sapiens
  heavy chain complementarity determining region 3 for antibody 59745
ARGLEQQLVFDY

SEQ ID NO: 119491 - protein, 9 aa, Homo sapiens
  light chain complementarity determining region 3 for antibody 59746
QQYNSYPPT

SEQ ID NO: 119492 - protein, 12 aa, Homo sapiens
  heavy chain complementarity determining region 3 for antibody 59746
AREVEQQLVFAY

SEQ ID NO: 119493 - protein, 9 aa, Homo sapiens
  light chain complementarity determining region 3 for antibody 59747
QQYNSYPPT

SEQ ID NO: 119494 - protein, 12 aa, Homo sapiens
  heavy chain complementarity determining region 3 for antibody 59747
AREVEHQLVIDY

SEQ ID NO: 119495 - protein, 9 aa, Homo sapiens
  light chain complementarity determining region 3 for antibody 59748
QQYNSYPPT

SEQ ID NO: 119496 - protein, 12 aa, Homo sapiens
  heavy chain complementarity determining region 3 for antibody 59748
ARELKQQLAFDY

SEQ ID NO: 119497 - protein, 9 aa, Homo sapiens
  light chain complementarity determining region 3 for antibody 59749
QQYNSYPPT

SEQ ID NO: 119498 - protein, 12 aa, Homo sapiens
  heavy chain complementarity determining region 3 for antibody 59749
ARELGQQSVFDY

SEQ ID NO: 119499 - protein, 9 aa, Homo sapiens
  light chain complementarity determining region 3 for antibody 59750
QQYNSYPPT

SEQ ID NO: 119500 - protein, 12 aa, Homo sapiens
  heavy chain complementarity determining region 3 for antibody 59750
ARELEQQWAFDY

SEQ ID NO: 119501 - protein, 9 aa, Homo sapiens
  light chain complementarity determining region 3 for antibody 59751
QQYNSYPPT

SEQ ID NO: 119502 - protein, 12 aa, Homo sapiens
  heavy chain complementarity determining region 3 for antibody 59751
ARELEQQSVFDS

SEQ ID NO: 119503 - protein, 9 aa, Homo sapiens
  light chain complementarity determining region 3 for antibody 59752
QQYNSYPPT

SEQ ID NO: 119504 - protein, 12 aa, Homo sapiens
  heavy chain complementarity determining region 3 for antibody 59752
ARELEQQLVINY

SEQ ID NO: 119505 - protein, 9 aa, Homo sapiens
  light chain complementarity determining region 3 for antibody 59753
QQYNSYPPT

SEQ ID NO: 119506 - protein, 12 aa, Homo sapiens
  heavy chain complementarity determining region 3 for antibody 59753
ARELEQQLVFDD

SEQ ID NO: 119507 - protein, 9 aa, Homo sapiens
  light chain complementarity determining region 3 for antibody 59754
QQYNSYPPT

SEQ ID NO: 119508 - protein, 12 aa, Homo sapiens
  heavy chain complementarity determining region 3 for antibody 59754
ARELEQQFVFDY

SEQ ID NO: 119509 - protein, 9 aa, Homo sapiens
  light chain complementarity determining region 3 for antibody 59755
QQYNSYPPT

SEQ ID NO: 119510 - protein, 12 aa, Homo sapiens
  heavy chain complementarity determining region 3 for antibody 59755
ARELEQHSVFDY

SEQ ID NO: 119511 - protein, 9 aa, Homo sapiens
  light chain complementarity determining region 3 for antibody 59756
QQYNSYPPT

SEQ ID NO: 119512 - protein, 12 aa, Homo sapiens
  heavy chain complementarity determining region 3 for antibody 59756
ARELEQHLVIDY

SEQ ID NO: 119513 - protein, 9 aa, Homo sapiens
  light chain complementarity determining region 3 for antibody 59757
QQYNSYPPT

SEQ ID NO: 119514 - protein, 12 aa, Homo sapiens
  heavy chain complementarity determining region 3 for antibody 59757
ARELDQQLVIDY

SEQ ID NO: 119515 - protein, 9 aa, Homo sapiens
  light chain complementarity determining region 3 for antibody 59758
QQYNSYPPT

SEQ ID NO: 119516 - protein, 12 aa, Homo sapiens
  heavy chain complementarity determining region 3 for antibody 59758
ARELDQQLAFDY

SEQ ID NO: 119517 - protein, 9 aa, Homo sapiens
  light chain complementarity determining region 3 for antibody 59759
QQYNSYPPT

SEQ ID NO: 119518 - protein, 12 aa, Homo sapiens
  heavy chain complementarity determining region 3 for antibody 59759
ARELAQQLVFDS

SEQ ID NO: 119519 - protein, 9 aa, Homo sapiens
  light chain complementarity determining region 3 for antibody 59760
QQYNSYPPT

SEQ ID NO: 119520 - protein, 12 aa, Homo sapiens
  heavy chain complementarity determining region 3 for antibody 59760
ARELAQHLVFDY

SEQ ID NO: 119521 - protein, 9 aa, Homo sapiens
  light chain complementarity determining region 3 for antibody 59761
QQYNSYPPT

SEQ ID NO: 119522 - protein, 12 aa, Homo sapiens
  heavy chain complementarity determining region 3 for antibody 59761
ARELAHQLVIDY

SEQ ID NO: 119523 - protein, 9 aa, Homo sapiens
  light chain complementarity determining region 3 for antibody 59762
QQYNSYPPT

SEQ ID NO: 119524 - protein, 12 aa, Homo sapiens
  heavy chain complementarity determining region 3 for antibody 59762
AREFEQQLVFDS

SEQ ID NO: 119525 - protein, 9 aa, Homo sapiens
  light chain complementarity determining region 3 for antibody 59763
QQYNSYPPT

SEQ ID NO: 119526 - protein, 12 aa, Homo sapiens
  heavy chain complementarity determining region 3 for antibody 59763
AREFEHQLVFDY

SEQ ID NO: 119527 - protein, 9 aa, Homo sapiens
  light chain complementarity determining region 3 for antibody 59764
QQYNSYPPT

SEQ ID NO: 119528 - protein, 12 aa, Homo sapiens
  heavy chain complementarity determining region 3 for antibody 59764
AREFAQQLVFDY

SEQ ID NO: 119529 - protein, 9 aa, Homo sapiens
  light chain complementarity determining region 3 for antibody 59765
QQYNSYPPN

SEQ ID NO: 119530 - protein, 12 aa, Homo sapiens
  heavy chain complementarity determining region 3 for antibody 59765
ARELEQQLVFDY

SEQ ID NO: 119531 - protein, 9 aa, Homo sapiens
  light chain complementarity determining region 3 for antibody 59766
QQYNSYPLT

SEQ ID NO: 119532 - protein, 14 aa, Homo sapiens
  heavy chain complementarity determining region 3 for antibody 59766
ARDRYGGNLNWFAP

SEQ ID NO: 119533 - protein, 9 aa, Homo sapiens
  light chain complementarity determining region 3 for antibody 59767
QQYNSYPLT

SEQ ID NO: 119534 - protein, 14 aa, Homo sapiens
  heavy chain complementarity determining region 3 for antibody 59767
AGDRYGGNLNWFDP

SEQ ID NO: 119535 - protein, 9 aa, Homo sapiens
  light chain complementarity determining region 3 for antibody 59768
QQYNSYPHT

SEQ ID NO: 119536 - protein, 12 aa, Homo sapiens
  heavy chain complementarity determining region 3 for antibody 59768
ARELEQQLVFDY

SEQ ID NO: 119537 - protein, 9 aa, Homo sapiens
  light chain complementarity determining region 3 for antibody 59769
QQYNSFPRT

SEQ ID NO: 119538 - protein, 10 aa, Homo sapiens
  heavy chain complementarity determining region 3 for antibody 59769
ARGRLTGDNN

SEQ ID NO: 119539 - protein, 9 aa, Homo sapiens
  light chain complementarity determining region 3 for antibody 59770
QQYNSFPRT

SEQ ID NO: 119540 - protein, 10 aa, Homo sapiens
  heavy chain complementarity determining region 3 for antibody 59770
ARGRLTANNN

SEQ ID NO: 119541 - protein, 9 aa, Homo sapiens
  light chain complementarity determining region 3 for antibody 59771
QQYKSYPYT

SEQ ID NO: 119542 - protein, 13 aa, Homo sapiens
  heavy chain complementarity determining region 3 for antibody 59771
ARERWESGVYCEY

SEQ ID NO: 119543 - protein, 9 aa, Homo sapiens
  light chain complementarity determining region 3 for antibody 59772
QQYKSYPYT

SEQ ID NO: 119544 - protein, 13 aa, Homo sapiens
  heavy chain complementarity determining region 3 for antibody 59772
ARERWEPEVYCEY

SEQ ID NO: 119545 - protein, 9 aa, Homo sapiens
  light chain complementarity determining region 3 for antibody 59773
QQYKSYPYT

SEQ ID NO: 119546 - protein, 13 aa, Homo sapiens
  heavy chain complementarity determining region 3 for antibody 59773
ARERWDPGVYCEY

SEQ ID NO: 119547 - protein, 9 aa, Homo sapiens
  light chain complementarity determining region 3 for antibody 59774
QQYKSYPYT

SEQ ID NO: 119548 - protein, 13 aa, Homo sapiens
  heavy chain complementarity determining region 3 for antibody 59774
ARERWAPGVYCEY

SEQ ID NO: 119549 - protein, 9 aa, Homo sapiens
  light chain complementarity determining region 3 for antibody 59775
QQYKSYPYT

SEQ ID NO: 119550 - protein, 13 aa, Homo sapiens
  heavy chain complementarity determining region 3 for antibody 59775
ARERLEPGVYCEY

SEQ ID NO: 119551 - protein, 9 aa, Homo sapiens
  light chain complementarity determining region 3 for antibody 59776
QQYKSYPYT

SEQ ID NO: 119552 - protein, 13 aa, Homo sapiens
  heavy chain complementarity determining region 3 for antibody 59776
AGERWEPGVYCEY

SEQ ID NO: 119553 - protein, 9 aa, Homo sapiens
  light chain complementarity determining region 3 for antibody 59777
QQYKSYPYP

SEQ ID NO: 119554 - protein, 13 aa, Homo sapiens
  heavy chain complementarity determining region 3 for antibody 59777
ARERWEPGVYCEY

SEQ ID NO: 119555 - protein, 9 aa, Homo sapiens
  light chain complementarity determining region 3 for antibody 59778
QQYKSYPCT

SEQ ID NO: 119556 - protein, 13 aa, Homo sapiens
  heavy chain complementarity determining region 3 for antibody 59778
ARERWEPGVYCEY

SEQ ID NO: 119557 - protein, 9 aa, Homo sapiens
  light chain complementarity determining region 3 for antibody 59779
QQYGSSPYT

SEQ ID NO: 119558 - protein, 19 aa, Homo sapiens
  heavy chain complementarity determining region 3 for antibody 59779
AWGDSLLWFGELFPDAFDI

SEQ ID NO: 119559 - protein, 9 aa, Homo sapiens
  light chain complementarity determining region 3 for antibody 59780
QQYGSSPYT

SEQ ID NO: 119560 - protein, 19 aa, Homo sapiens
  heavy chain complementarity determining region 3 for antibody 59780
ASGDSLLWFGELLPDAFDI

SEQ ID NO: 119561 - protein, 9 aa, Homo sapiens
  light chain complementarity determining region 3 for antibody 59781
QQYGSSPYT

SEQ ID NO: 119562 - protein, 19 aa, Homo sapiens
  heavy chain complementarity determining region 3 for antibody 59781
ARGDSLQWFGELLPDAFDI

SEQ ID NO: 119563 - protein, 9 aa, Homo sapiens
  light chain complementarity determining region 3 for antibody 59782
QQYGSSPYT

SEQ ID NO: 119564 - protein, 19 aa, Homo sapiens
  heavy chain complementarity determining region 3 for antibody 59782
ARGDSLLWFGELLSDAFDI

SEQ ID NO: 119565 - protein, 9 aa, Homo sapiens
  light chain complementarity determining region 3 for antibody 59783
QQYGSSPYT

SEQ ID NO: 119566 - protein, 19 aa, Homo sapiens
  heavy chain complementarity determining region 3 for antibody 59783
ARGDSLLWFGELLPEAFDI

SEQ ID NO: 119567 - protein, 9 aa, Homo sapiens
  light chain complementarity determining region 3 for antibody 59784
QQYGSSPYT

SEQ ID NO: 119568 - protein, 19 aa, Homo sapiens
  heavy chain complementarity determining region 3 for antibody 59784
ARGDSLLWCGELLPDAFDI

SEQ ID NO: 119569 - protein, 9 aa, Homo sapiens
  light chain complementarity determining region 3 for antibody 59785
QQYGSSPYT

SEQ ID NO: 119570 - protein, 19 aa, Homo sapiens
  heavy chain complementarity determining region 3 for antibody 59785
ARGDSLLGFGEFLPDAFDI

SEQ ID NO: 119571 - protein, 9 aa, Homo sapiens
  light chain complementarity determining region 3 for antibody 59786
QQYGSSPYT

SEQ ID NO: 119572 - protein, 19 aa, Homo sapiens
  heavy chain complementarity determining region 3 for antibody 59786
ARGDSFLWFGELLPDAFDI

SEQ ID NO: 119573 - protein, 9 aa, Homo sapiens
  light chain complementarity determining region 3 for antibody 59787
QQYGSSPYT

SEQ ID NO: 119574 - protein, 19 aa, Homo sapiens
  heavy chain complementarity determining region 3 for antibody 59787
ARGDSFLWFGELFPDAFDI

SEQ ID NO: 119575 - protein, 9 aa, Homo sapiens
  light chain complementarity determining region 3 for antibody 59788
QQYGSSPPT

SEQ ID NO: 119576 - protein, 12 aa, Homo sapiens
  heavy chain complementarity determining region 3 for antibody 59788
ARQQWLVPYFDC

SEQ ID NO: 119577 - protein, 9 aa, Homo sapiens
  light chain complementarity determining region 3 for antibody 59789
QQYGSSPLT

SEQ ID NO: 119578 - protein, 12 aa, Homo sapiens
  heavy chain complementarity determining region 3 for antibody 59789
ARQQWPVPYFDC

SEQ ID NO: 119579 - protein, 9 aa, Homo sapiens
  light chain complementarity determining region 3 for antibody 59790
QQYGSSPLT

SEQ ID NO: 119580 - protein, 12 aa, Homo sapiens
  heavy chain complementarity determining region 3 for antibody 59790
ARQQWLVPYFDF

SEQ ID NO: 119581 - protein, 9 aa, Homo sapiens
  light chain complementarity determining region 3 for antibody 59791
QQYGSSPLT

SEQ ID NO: 119582 - protein, 12 aa, Homo sapiens
  heavy chain complementarity determining region 3 for antibody 59791
ARQQWLGPYFDC

SEQ ID NO: 119583 - protein, 9 aa, Homo sapiens
  light chain complementarity determining region 3 for antibody 59792
QQYGSSPLT

SEQ ID NO: 119584 - protein, 12 aa, Homo sapiens
  heavy chain complementarity determining region 3 for antibody 59792
ARQQSLVPYFDC

SEQ ID NO: 119585 - protein, 9 aa, Homo sapiens
  light chain complementarity determining region 3 for antibody 59793
QQYGSSPLT

SEQ ID NO: 119586 - protein, 12 aa, Homo sapiens
  heavy chain complementarity determining region 3 for antibody 59793
ARQQRLVPYFDC

SEQ ID NO: 119587 - protein, 9 aa, Homo sapiens
  light chain complementarity determining region 3 for antibody 59794
QQYDNLPYT

SEQ ID NO: 119588 - protein, 12 aa, Homo sapiens
  heavy chain complementarity determining region 3 for antibody 59794
GRAVAGYWYFDL

SEQ ID NO: 119589 - protein, 9 aa, Homo sapiens
  light chain complementarity determining region 3 for antibody 59795
QQYDNLPYT

SEQ ID NO: 119590 - protein, 9 aa, Homo sapiens
  heavy chain complementarity determining region 3 for antibody 59795
EKDGAVAQH

SEQ ID NO: 119591 - protein, 9 aa, Homo sapiens
  light chain complementarity determining region 3 for antibody 59796
QQYDNLPYT

SEQ ID NO: 119592 - protein, 12 aa, Homo sapiens
  heavy chain complementarity determining region 3 for antibody 59796
ARGVAGYWYIDL

SEQ ID NO: 119593 - protein, 9 aa, Homo sapiens
  light chain complementarity determining region 3 for antibody 59797
QQYDNLPYT

SEQ ID NO: 119594 - protein, 12 aa, Homo sapiens
  heavy chain complementarity determining region 3 for antibody 59797
ARAVDGYWYFDL

SEQ ID NO: 119595 - protein, 9 aa, Homo sapiens
  light chain complementarity determining region 3 for antibody 59798
QQYDNLPYT

SEQ ID NO: 119596 - protein, 12 aa, Homo sapiens
  heavy chain complementarity determining region 3 for antibody 59798
ARAVAVYWSFDL

SEQ ID NO: 119597 - protein, 9 aa, Homo sapiens
  light chain complementarity determining region 3 for antibody 59799
QQYDNLPYT

SEQ ID NO: 119598 - protein, 12 aa, Homo sapiens
  heavy chain complementarity determining region 3 for antibody 59799
ARAVAVSWYFDL

SEQ ID NO: 119599 - protein, 9 aa, Homo sapiens
  light chain complementarity determining region 3 for antibody 59800
QQYDNLPYT

SEQ ID NO: 119600 - protein, 12 aa, Homo sapiens
  heavy chain complementarity determining region 3 for antibody 59800
ARAVASYWYFDL

SEQ ID NO: 119601 - protein, 9 aa, Homo sapiens
  light chain complementarity determining region 3 for antibody 59801
QQYDNLPYT

SEQ ID NO: 119602 - protein, 12 aa, Homo sapiens
  heavy chain complementarity determining region 3 for antibody 59801
ARAVAGYWSLDL

SEQ ID NO: 119603 - protein, 9 aa, Homo sapiens
  light chain complementarity determining region 3 for antibody 59802
QQYDNLPYT

SEQ ID NO: 119604 - protein, 12 aa, Homo sapiens
  heavy chain complementarity determining region 3 for antibody 59802
ARAVAGYWDFEL

SEQ ID NO: 119605 - protein, 9 aa, Homo sapiens
  light chain complementarity determining region 3 for antibody 59803
QQYDNLPYT

SEQ ID NO: 119606 - protein, 12 aa, Homo sapiens
  heavy chain complementarity determining region 3 for antibody 59803
ARAVAGYSSFDL

SEQ ID NO: 119607 - protein, 9 aa, Homo sapiens
  light chain complementarity determining region 3 for antibody 59804
QQYDNLPYT

SEQ ID NO: 119608 - protein, 12 aa, Homo sapiens
  heavy chain complementarity determining region 3 for antibody 59804
ARAVAGYLYFDL

SEQ ID NO: 119609 - protein, 9 aa, Homo sapiens
  light chain complementarity determining region 3 for antibody 59805
QQYDNLPYT

SEQ ID NO: 119610 - protein, 12 aa, Homo sapiens
  heavy chain complementarity determining region 3 for antibody 59805
ARAVAGSWYFAL

SEQ ID NO: 119611 - protein, 9 aa, Homo sapiens
  light chain complementarity determining region 3 for antibody 59806
QQYDNLPYT

SEQ ID NO: 119612 - protein, 12 aa, Homo sapiens
  heavy chain complementarity determining region 3 for antibody 59806
ARAVAGFWYFDL

SEQ ID NO: 119613 - protein, 9 aa, Homo sapiens
  light chain complementarity determining region 3 for antibody 59807
QQYDNLPYT

SEQ ID NO: 119614 - protein, 12 aa, Homo sapiens
  heavy chain complementarity determining region 3 for antibody 59807
ARAVAAYWYFDL

SEQ ID NO: 119615 - protein, 9 aa, Homo sapiens
  light chain complementarity determining region 3 for antibody 59808
QQYDNLPYT

SEQ ID NO: 119616 - protein, 12 aa, Homo sapiens
  heavy chain complementarity determining region 3 for antibody 59808
ARAEAGYWYFDL

SEQ ID NO: 119617 - protein, 9 aa, Homo sapiens
  light chain complementarity determining region 3 for antibody 59809
QQYDNLPYT

SEQ ID NO: 119618 - protein, 12 aa, Homo sapiens
  heavy chain complementarity determining region 3 for antibody 59809
ARAAAGYWYFDL

SEQ ID NO: 119619 - protein, 9 aa, Homo sapiens
  light chain complementarity determining region 3 for antibody 59810
QQYDNLPYT

SEQ ID NO: 119620 - protein, 9 aa, Homo sapiens
  heavy chain complementarity determining region 3 for antibody 59810
ANDGAVDQH

SEQ ID NO: 119621 - protein, 9 aa, Homo sapiens
  light chain complementarity determining region 3 for antibody 59811
QQYDNLPYT

SEQ ID NO: 119622 - protein, 9 aa, Homo sapiens
  heavy chain complementarity determining region 3 for antibody 59811
ANDGAVDHH

SEQ ID NO: 119623 - protein, 9 aa, Homo sapiens
  light chain complementarity determining region 3 for antibody 59812
QQYDNLPYT

SEQ ID NO: 119624 - protein, 9 aa, Homo sapiens
  heavy chain complementarity determining region 3 for antibody 59812
AKDGAVPQH

SEQ ID NO: 119625 - protein, 9 aa, Homo sapiens
  light chain complementarity determining region 3 for antibody 59813
QQYDNLPYT

SEQ ID NO: 119626 - protein, 9 aa, Homo sapiens
  heavy chain complementarity determining region 3 for antibody 59813
AKDGAVIQH

SEQ ID NO: 119627 - protein, 9 aa, Homo sapiens
  light chain complementarity determining region 3 for antibody 59814
QQYDNLPYT

SEQ ID NO: 119628 - protein, 9 aa, Homo sapiens
  heavy chain complementarity determining region 3 for antibody 59814
AKDGAVAQD

SEQ ID NO: 119629 - protein, 9 aa, Homo sapiens
  light chain complementarity determining region 3 for antibody 59815
QQYDNLPYT

SEQ ID NO: 119630 - protein, 9 aa, Homo sapiens
  heavy chain complementarity determining region 3 for antibody 59815
AKDEAVAQH

SEQ ID NO: 119631 - protein, 9 aa, Homo sapiens
  light chain complementarity determining region 3 for antibody 59816
QQYDNLPYT

SEQ ID NO: 119632 - protein, 9 aa, Homo sapiens
  heavy chain complementarity determining region 3 for antibody 59816
AKAGAVAQH

SEQ ID NO: 119633 - protein, 9 aa, Homo sapiens
  light chain complementarity determining region 3 for antibody 59817
QQYDNLPYT

SEQ ID NO: 119634 - protein, 12 aa, Homo sapiens
  heavy chain complementarity determining region 3 for antibody 59817
AIAVAGYWYFDL

SEQ ID NO: 119635 - protein, 9 aa, Homo sapiens
  light chain complementarity determining region 3 for antibody 59818
QQYDNLPYT

SEQ ID NO: 119636 - protein, 9 aa, Homo sapiens
  heavy chain complementarity determining region 3 for antibody 59818
AEDGAVAQH

SEQ ID NO: 119637 - protein, 9 aa, Homo sapiens
  light chain complementarity determining region 3 for antibody 59819
QQYDNLPST

SEQ ID NO: 119638 - protein, 12 aa, Homo sapiens
  heavy chain complementarity determining region 3 for antibody 59819
ARAVAGYWYFDL

SEQ ID NO: 119639 - protein, 9 aa, Homo sapiens
  light chain complementarity determining region 3 for antibody 59820
QQYDNLPHT

SEQ ID NO: 119640 - protein, 12 aa, Homo sapiens
  heavy chain complementarity determining region 3 for antibody 59820
ARAVAGYWYFDL

SEQ ID NO: 119641 - protein, 9 aa, Homo sapiens
  light chain complementarity determining region 3 for antibody 59821
QQYDNLLYT

SEQ ID NO: 119642 - protein, 12 aa, Homo sapiens
  heavy chain complementarity determining region 3 for antibody 59821
ARAVAGYWYFDL

SEQ ID NO: 119643 - protein, 9 aa, Homo sapiens
  light chain complementarity determining region 3 for antibody 59822
QQYDNIPYT

SEQ ID NO: 119644 - protein, 12 aa, Homo sapiens
  heavy chain complementarity determining region 3 for antibody 59822
ARAVAGYWYFDL

SEQ ID NO: 119645 - protein, 9 aa, Homo sapiens
  light chain complementarity determining region 3 for antibody 59823
QQVNSFPWT

SEQ ID NO: 119646 - protein, 7 aa, Homo sapiens
  heavy chain complementarity determining region 3 for antibody 59823
ERDFFDY

SEQ ID NO: 119647 - protein, 9 aa, Homo sapiens
  light chain complementarity determining region 3 for antibody 59824
QQSYSTPST

SEQ ID NO: 119648 - protein, 12 aa, Homo sapiens
  heavy chain complementarity determining region 3 for antibody 59824
ASLGWELHDFDY

SEQ ID NO: 119649 - protein, 9 aa, Homo sapiens
  light chain complementarity determining region 3 for antibody 59825
QQSYSTPFT

SEQ ID NO: 119650 - protein, 12 aa, Homo sapiens
  heavy chain complementarity determining region 3 for antibody 59825
ARLGWELHGFDY

SEQ ID NO: 119651 - protein, 9 aa, Homo sapiens
  light chain complementarity determining region 3 for antibody 59826
QQSYSTPFT

SEQ ID NO: 119652 - protein, 12 aa, Homo sapiens
  heavy chain complementarity determining region 3 for antibody 59826
ARLGWELHDIDY

SEQ ID NO: 119653 - protein, 9 aa, Homo sapiens
  light chain complementarity determining region 3 for antibody 59827
QQSYSTPFT

SEQ ID NO: 119654 - protein, 12 aa, Homo sapiens
  heavy chain complementarity determining region 3 for antibody 59827
ARLGWELHDFAY

SEQ ID NO: 119655 - protein, 9 aa, Homo sapiens
  light chain complementarity determining region 3 for antibody 59828
QQSYSTPFT

SEQ ID NO: 119656 - protein, 12 aa, Homo sapiens
  heavy chain complementarity determining region 3 for antibody 59828
ARLGCELHDFDY

SEQ ID NO: 119657 - protein, 9 aa, Homo sapiens
  light chain complementarity determining region 3 for antibody 59829
QQNDNLPYT

SEQ ID NO: 119658 - protein, 12 aa, Homo sapiens
  heavy chain complementarity determining region 3 for antibody 59829
ARAVAGYWYFDL

SEQ ID NO: 119659 - protein, 9 aa, Homo sapiens
  light chain complementarity determining region 3 for antibody 59830
QQLNTYPLT

SEQ ID NO: 119660 - protein, 9 aa, Homo sapiens
  heavy chain complementarity determining region 3 for antibody 59830
ARKKGAFDY

SEQ ID NO: 119661 - protein, 9 aa, Homo sapiens
  light chain complementarity determining region 3 for antibody 59831
QQLNSYPYT

SEQ ID NO: 119662 - protein, 19 aa, Homo sapiens
  heavy chain complementarity determining region 3 for antibody 59831
SRKGHYDILTGYYPDAFDI

SEQ ID NO: 119663 - protein, 9 aa, Homo sapiens
  light chain complementarity determining region 3 for antibody 59832
QQLNSYPYT

SEQ ID NO: 119664 - protein, 19 aa, Homo sapiens
  heavy chain complementarity determining region 3 for antibody 59832
ARKVHYDILTGYYPDAFDI

SEQ ID NO: 119665 - protein, 9 aa, Homo sapiens
  light chain complementarity determining region 3 for antibody 59833
QQLNSYPYT

SEQ ID NO: 119666 - protein, 19 aa, Homo sapiens
  heavy chain complementarity determining region 3 for antibody 59833
ARKGYYDMLTGYYPDAFDI

SEQ ID NO: 119667 - protein, 9 aa, Homo sapiens
  light chain complementarity determining region 3 for antibody 59834
QQLNSYPYT

SEQ ID NO: 119668 - protein, 19 aa, Homo sapiens
  heavy chain complementarity determining region 3 for antibody 59834
ARKGYYDILTGYFPDAFDI

SEQ ID NO: 119669 - protein, 9 aa, Homo sapiens
  light chain complementarity determining region 3 for antibody 59835
QQLNSYPYT

SEQ ID NO: 119670 - protein, 19 aa, Homo sapiens
  heavy chain complementarity determining region 3 for antibody 59835
ARKGQYEILTGYYPDAFDI

SEQ ID NO: 119671 - protein, 9 aa, Homo sapiens
  light chain complementarity determining region 3 for antibody 59836
QQLNSYPYT

SEQ ID NO: 119672 - protein, 19 aa, Homo sapiens
  heavy chain complementarity determining region 3 for antibody 59836
ARKGQYDILTGYFPDAFDI

SEQ ID NO: 119673 - protein, 9 aa, Homo sapiens
  light chain complementarity determining region 3 for antibody 59837
QQLNSYPYT

SEQ ID NO: 119674 - protein, 19 aa, Homo sapiens
  heavy chain complementarity determining region 3 for antibody 59837
ARKGHYDSVTGYYPDAFDI

SEQ ID NO: 119675 - protein, 9 aa, Homo sapiens
  light chain complementarity determining region 3 for antibody 59838
QQLNSYPYT

SEQ ID NO: 119676 - protein, 19 aa, Homo sapiens
  heavy chain complementarity determining region 3 for antibody 59838
ARKGHYDSLTGYYPDAFEI

SEQ ID NO: 119677 - protein, 9 aa, Homo sapiens
  light chain complementarity determining region 3 for antibody 59839
QQLNSYPYT

SEQ ID NO: 119678 - protein, 19 aa, Homo sapiens
  heavy chain complementarity determining region 3 for antibody 59839
ARKGHYDSLTGYSPDAFDI

SEQ ID NO: 119679 - protein, 9 aa, Homo sapiens
  light chain complementarity determining region 3 for antibody 59840
QQLNSYPYT

SEQ ID NO: 119680 - protein, 19 aa, Homo sapiens
  heavy chain complementarity determining region 3 for antibody 59840
ARKGHYDSLTGYCPDAFDI

SEQ ID NO: 119681 - protein, 9 aa, Homo sapiens
  light chain complementarity determining region 3 for antibody 59841
QQLNSYPYT

SEQ ID NO: 119682 - protein, 19 aa, Homo sapiens
  heavy chain complementarity determining region 3 for antibody 59841
ARKGHYDISTGYYPDAFDI

SEQ ID NO: 119683 - protein, 9 aa, Homo sapiens
  light chain complementarity determining region 3 for antibody 59842
QQLNSYPYT

SEQ ID NO: 119684 - protein, 19 aa, Homo sapiens
  heavy chain complementarity determining region 3 for antibody 59842
ARKGHYDILTGYYPDALDI

SEQ ID NO: 119685 - protein, 9 aa, Homo sapiens
  light chain complementarity determining region 3 for antibody 59843
QQLNSYPYT

SEQ ID NO: 119686 - protein, 19 aa, Homo sapiens
  heavy chain complementarity determining region 3 for antibody 59843
ARKGHYDILTGYYPDAFAI

SEQ ID NO: 119687 - protein, 9 aa, Homo sapiens
  light chain complementarity determining region 3 for antibody 59844
QQLNSYPYT

SEQ ID NO: 119688 - protein, 19 aa, Homo sapiens
  heavy chain complementarity determining region 3 for antibody 59844
ARKGHYDILTGYYPDACDI

SEQ ID NO: 119689 - protein, 9 aa, Homo sapiens
  light chain complementarity determining region 3 for antibody 59845
QQLNSYPYT

SEQ ID NO: 119690 - protein, 19 aa, Homo sapiens
  heavy chain complementarity determining region 3 for antibody 59845
ARKGHYDILTGYYPAAFDI

SEQ ID NO: 119691 - protein, 9 aa, Homo sapiens
  light chain complementarity determining region 3 for antibody 59846
QQLNSYPYT

SEQ ID NO: 119692 - protein, 19 aa, Homo sapiens
  heavy chain complementarity determining region 3 for antibody 59846
ARKGHYDILTGYFPDAFGI

SEQ ID NO: 119693 - protein, 9 aa, Homo sapiens
  light chain complementarity determining region 3 for antibody 59847
QQLNSYPYT

SEQ ID NO: 119694 - protein, 19 aa, Homo sapiens
  heavy chain complementarity determining region 3 for antibody 59847
ARKGHYDILTDYYPDAFDI

SEQ ID NO: 119695 - protein, 9 aa, Homo sapiens
  light chain complementarity determining region 3 for antibody 59848
QQLNSYPYT

SEQ ID NO: 119696 - protein, 19 aa, Homo sapiens
  heavy chain complementarity determining region 3 for antibody 59848
ARKGHYDILPGYYPDAFDI

SEQ ID NO: 119697 - protein, 9 aa, Homo sapiens
  light chain complementarity determining region 3 for antibody 59849
QQLNSYPYT

SEQ ID NO: 119698 - protein, 19 aa, Homo sapiens
  heavy chain complementarity determining region 3 for antibody 59849
ARKGHFDILTGYYPDAFDI

SEQ ID NO: 119699 - protein, 9 aa, Homo sapiens
  light chain complementarity determining region 3 for antibody 59850
QQLNSYPYT

SEQ ID NO: 119700 - protein, 19 aa, Homo sapiens
  heavy chain complementarity determining region 3 for antibody 59850
ARKGEYDILTGYYPDAFDI

SEQ ID NO: 119701 - protein, 9 aa, Homo sapiens
  light chain complementarity determining region 3 for antibody 59851
QQLNSYPYT

SEQ ID NO: 119702 - protein, 19 aa, Homo sapiens
  heavy chain complementarity determining region 3 for antibody 59851
ARKGDYDMLTGYYPDAFDI

SEQ ID NO: 119703 - protein, 9 aa, Homo sapiens
  light chain complementarity determining region 3 for antibody 59852
QQLNSYPYT

SEQ ID NO: 119704 - protein, 19 aa, Homo sapiens
  heavy chain complementarity determining region 3 for antibody 59852
ARKGDYDIVTGYYPDAFDI

SEQ ID NO: 119705 - protein, 9 aa, Homo sapiens
  light chain complementarity determining region 3 for antibody 59853
QQLNSYPYT

SEQ ID NO: 119706 - protein, 19 aa, Homo sapiens
  heavy chain complementarity determining region 3 for antibody 59853
AREGQYDILTGYYPDAFDI

SEQ ID NO: 119707 - protein, 9 aa, Homo sapiens
  light chain complementarity determining region 3 for antibody 59854
QQLNSYPYT

SEQ ID NO: 119708 - protein, 19 aa, Homo sapiens
  heavy chain complementarity determining region 3 for antibody 59854
AREGHYDILTGYYSDAFDI

SEQ ID NO: 119709 - protein, 9 aa, Homo sapiens
  light chain complementarity determining region 3 for antibody 59855
QQLNSYPYT

SEQ ID NO: 119710 - protein, 19 aa, Homo sapiens
  heavy chain complementarity determining region 3 for antibody 59855
AREGDYDILTGYYPDAFDI

SEQ ID NO: 119711 - protein, 9 aa, Homo sapiens
  light chain complementarity determining region 3 for antibody 59856
QQLNSYPYT

SEQ ID NO: 119712 - protein, 13 aa, Homo sapiens
  heavy chain complementarity determining region 3 for antibody 59856
ARDQDSGSGTPDY

SEQ ID NO: 119713 - protein, 9 aa, Homo sapiens
  light chain complementarity determining region 3 for antibody 59857
QQLNSYPST

SEQ ID NO: 119714 - protein, 19 aa, Homo sapiens
  heavy chain complementarity determining region 3 for antibody 59857
ARKGHYDILTGYYPDAFDI

SEQ ID NO: 119715 - protein, 9 aa, Homo sapiens
  light chain complementarity determining region 3 for antibody 59858
QQLNSYPRT

SEQ ID NO: 119716 - protein, 15 aa, Homo sapiens
  heavy chain complementarity determining region 3 for antibody 59858
ARDENYYTYYYGMDV

SEQ ID NO: 119717 - protein, 9 aa, Homo sapiens
  light chain complementarity determining region 3 for antibody 59859
QQLNSYPRT

SEQ ID NO: 119718 - protein, 15 aa, Homo sapiens
  heavy chain complementarity determining region 3 for antibody 59859
ARDENYYTYYFGMDV

SEQ ID NO: 119719 - protein, 9 aa, Homo sapiens
  light chain complementarity determining region 3 for antibody 59860
QQLNSYPRT

SEQ ID NO: 119720 - protein, 15 aa, Homo sapiens
  heavy chain complementarity determining region 3 for antibody 59860
ARDENYYSYYFGMDV

SEQ ID NO: 119721 - protein, 9 aa, Homo sapiens
  light chain complementarity determining region 3 for antibody 59861
QQLNSYPRT

SEQ ID NO: 119722 - protein, 15 aa, Homo sapiens
  heavy chain complementarity determining region 3 for antibody 59861
ARDENYYNYYVGMDV

SEQ ID NO: 119723 - protein, 9 aa, Homo sapiens
  light chain complementarity determining region 3 for antibody 59862
QQLNSYPRT

SEQ ID NO: 119724 - protein, 15 aa, Homo sapiens
  heavy chain complementarity determining region 3 for antibody 59862
ARDENYYNFYFGMDV

SEQ ID NO: 119725 - protein, 9 aa, Homo sapiens
  light chain complementarity determining region 3 for antibody 59863
QQLNSYPRT

SEQ ID NO: 119726 - protein, 15 aa, Homo sapiens
  heavy chain complementarity determining region 3 for antibody 59863
ARDENYSNYYYGMDV

SEQ ID NO: 119727 - protein, 9 aa, Homo sapiens
  light chain complementarity determining region 3 for antibody 59864
QQLNSYPRT

SEQ ID NO: 119728 - protein, 15 aa, Homo sapiens
  heavy chain complementarity determining region 3 for antibody 59864
ARDENCYNYYFGMDV

SEQ ID NO: 119729 - protein, 9 aa, Homo sapiens
  light chain complementarity determining region 3 for antibody 59865
QQLNSYPRT

SEQ ID NO: 119730 - protein, 12 aa, Homo sapiens
  heavy chain complementarity determining region 3 for antibody 59865
ARAVAGYWYFDL

SEQ ID NO: 119731 - protein, 9 aa, Homo sapiens
  light chain complementarity determining region 3 for antibody 59866
QQLNSYPLT

SEQ ID NO: 119732 - protein, 14 aa, Homo sapiens
  heavy chain complementarity determining region 3 for antibody 59866
ARGTSVFLWFGADY

SEQ ID NO: 119733 - protein, 9 aa, Homo sapiens
  light chain complementarity determining region 3 for antibody 59867
QQLNSYPLT

SEQ ID NO: 119734 - protein, 14 aa, Homo sapiens
  heavy chain complementarity determining region 3 for antibody 59867
ARGSSVSLWFGTDY

SEQ ID NO: 119735 - protein, 9 aa, Homo sapiens
  light chain complementarity determining region 3 for antibody 59868
QQLNSYPLT

SEQ ID NO: 119736 - protein, 14 aa, Homo sapiens
  heavy chain complementarity determining region 3 for antibody 59868
ARGRSVSLCFGTDY

SEQ ID NO: 119737 - protein, 9 aa, Homo sapiens
  light chain complementarity determining region 3 for antibody 59869
QQLNSYPLT

SEQ ID NO: 119738 - protein, 14 aa, Homo sapiens
  heavy chain complementarity determining region 3 for antibody 59869
ARGRSVLLWYGADY

SEQ ID NO: 119739 - protein, 9 aa, Homo sapiens
  light chain complementarity determining region 3 for antibody 59870
QQLNSYPLT

SEQ ID NO: 119740 - protein, 14 aa, Homo sapiens
  heavy chain complementarity determining region 3 for antibody 59870
ARGRSVLLWFGSDY

SEQ ID NO: 119741 - protein, 9 aa, Homo sapiens
  light chain complementarity determining region 3 for antibody 59871
QQLNSYPLT

SEQ ID NO: 119742 - protein, 14 aa, Homo sapiens
  heavy chain complementarity determining region 3 for antibody 59871
ARGRSVLLWFGADS

SEQ ID NO: 119743 - protein, 9 aa, Homo sapiens
  light chain complementarity determining region 3 for antibody 59872
QQLNSYPLT

SEQ ID NO: 119744 - protein, 14 aa, Homo sapiens
  heavy chain complementarity determining region 3 for antibody 59872
ARGRSVFLWCGADY

SEQ ID NO: 119745 - protein, 9 aa, Homo sapiens
  light chain complementarity determining region 3 for antibody 59873
QQLNSYPLT

SEQ ID NO: 119746 - protein, 14 aa, Homo sapiens
  heavy chain complementarity determining region 3 for antibody 59873
AGGRSVLLWFAADY

SEQ ID NO: 119747 - protein, 9 aa, Homo sapiens
  light chain complementarity determining region 3 for antibody 59874
QQHDTLPSP

SEQ ID NO: 119748 - protein, 12 aa, Homo sapiens
  heavy chain complementarity determining region 3 for antibody 59874
ARAVAGYWYFDL

SEQ ID NO: 119749 - protein, 9 aa, Homo sapiens
  light chain complementarity determining region 3 for antibody 59875
QQGNTLPWT

SEQ ID NO: 119750 - protein, 16 aa, Homo sapiens
  heavy chain complementarity determining region 3 for antibody 59875
VRSYYGSSPYYYAMDY

SEQ ID NO: 119751 - protein, 9 aa, Homo sapiens
  light chain complementarity determining region 3 for antibody 59876
QQFSNYPHT

SEQ ID NO: 119752 - protein, 11 aa, Homo sapiens
  heavy chain complementarity determining region 3 for antibody 59876
ARDGYSYYFDY

SEQ ID NO: 119753 - protein, 10 aa, Homo sapiens
  light chain complementarity determining region 3 for antibody 59877
QQFNSYPPYT

SEQ ID NO: 119754 - protein, 14 aa, Homo sapiens
  heavy chain complementarity determining region 3 for antibody 59877
ARDGRLTRVRGGDF

SEQ ID NO: 119755 - protein, 10 aa, Homo sapiens
  light chain complementarity determining region 3 for antibody 59878
QQFNSYPPYT

SEQ ID NO: 119756 - protein, 14 aa, Homo sapiens
  heavy chain complementarity determining region 3 for antibody 59878
ARDGRLTMVRGWDF

SEQ ID NO: 119757 - protein, 10 aa, Homo sapiens
  light chain complementarity determining region 3 for antibody 59879
QQFNSYPPYT

SEQ ID NO: 119758 - protein, 14 aa, Homo sapiens
  heavy chain complementarity determining region 3 for antibody 59879
ARDGRLTMVRGGGF

SEQ ID NO: 119759 - protein, 10 aa, Homo sapiens
  light chain complementarity determining region 3 for antibody 59880
QQFNSYPPYT

SEQ ID NO: 119760 - protein, 14 aa, Homo sapiens
  heavy chain complementarity determining region 3 for antibody 59880
ARDGRLTMVRGGDV

SEQ ID NO: 119761 - protein, 10 aa, Homo sapiens
  light chain complementarity determining region 3 for antibody 59881
QQFNSYPPYT

SEQ ID NO: 119762 - protein, 14 aa, Homo sapiens
  heavy chain complementarity determining region 3 for antibody 59881
ARDGRLTMFRGGDF

SEQ ID NO: 119763 - protein, 10 aa, Homo sapiens
  light chain complementarity determining region 3 for antibody 59882
QQFNSYPPYT

SEQ ID NO: 119764 - protein, 14 aa, Homo sapiens
  heavy chain complementarity determining region 3 for antibody 59882
ARDGRLPMVRGGDF

SEQ ID NO: 119765 - protein, 10 aa, Homo sapiens
  light chain complementarity determining region 3 for antibody 59883
QQFNSYPPYT

SEQ ID NO: 119766 - protein, 14 aa, Homo sapiens
  heavy chain complementarity determining region 3 for antibody 59883
ARDGRLAMVRGGDF

SEQ ID NO: 119767 - protein, 10 aa, Homo sapiens
  light chain complementarity determining region 3 for antibody 59884
QQFNSYPPYT

SEQ ID NO: 119768 - protein, 14 aa, Homo sapiens
  heavy chain complementarity determining region 3 for antibody 59884
AGDGRLTMARGGDF

SEQ ID NO: 119769 - protein, 9 aa, Homo sapiens
  light chain complementarity determining region 3 for antibody 59885
QQFNNYPYT

SEQ ID NO: 119770 - protein, 15 aa, Homo sapiens
  heavy chain complementarity determining region 3 for antibody 59885
ASEGFGESLPWFFDL

SEQ ID NO: 119771 - protein, 9 aa, Homo sapiens
  light chain complementarity determining region 3 for antibody 59886
QQFNNYPYT

SEQ ID NO: 119772 - protein, 15 aa, Homo sapiens
  heavy chain complementarity determining region 3 for antibody 59886
AREGVGESLHWFFDL

SEQ ID NO: 119773 - protein, 9 aa, Homo sapiens
  light chain complementarity determining region 3 for antibody 59887
QQFNNYPYT

SEQ ID NO: 119774 - protein, 15 aa, Homo sapiens
  heavy chain complementarity determining region 3 for antibody 59887
AREGFGETLHWFFDL

SEQ ID NO: 119775 - protein, 9 aa, Homo sapiens
  light chain complementarity determining region 3 for antibody 59888
QQFNNYPYT

SEQ ID NO: 119776 - protein, 15 aa, Homo sapiens
  heavy chain complementarity determining region 3 for antibody 59888
AREGFGESLRWFFDL

SEQ ID NO: 119777 - protein, 9 aa, Homo sapiens
  light chain complementarity determining region 3 for antibody 59889
QQFNNYPYT

SEQ ID NO: 119778 - protein, 15 aa, Homo sapiens
  heavy chain complementarity determining region 3 for antibody 59889
AREGFGESLPWVFDL

SEQ ID NO: 119779 - protein, 9 aa, Homo sapiens
  light chain complementarity determining region 3 for antibody 59890
QQFNNYPYT

SEQ ID NO: 119780 - protein, 15 aa, Homo sapiens
  heavy chain complementarity determining region 3 for antibody 59890
AREGFGESLPWSFDL

SEQ ID NO: 119781 - protein, 9 aa, Homo sapiens
  light chain complementarity determining region 3 for antibody 59891
QQFNNYPYT

SEQ ID NO: 119782 - protein, 15 aa, Homo sapiens
  heavy chain complementarity determining region 3 for antibody 59891
AREGFGESLHWGFDL

SEQ ID NO: 119783 - protein, 9 aa, Homo sapiens
  light chain complementarity determining region 3 for antibody 59892
QQFNNYPYT

SEQ ID NO: 119784 - protein, 15 aa, Homo sapiens
  heavy chain complementarity determining region 3 for antibody 59892
AREGFGESLHWFFDV

SEQ ID NO: 119785 - protein, 9 aa, Homo sapiens
  light chain complementarity determining region 3 for antibody 59893
QQFNNYPYT

SEQ ID NO: 119786 - protein, 15 aa, Homo sapiens
  heavy chain complementarity determining region 3 for antibody 59893
AREGFGESLHWFCDL

SEQ ID NO: 119787 - protein, 9 aa, Homo sapiens
  light chain complementarity determining region 3 for antibody 59894
QQFNNYPYT

SEQ ID NO: 119788 - protein, 15 aa, Homo sapiens
  heavy chain complementarity determining region 3 for antibody 59894
AREGFGESFHWVFDL

SEQ ID NO: 119789 - protein, 9 aa, Homo sapiens
  light chain complementarity determining region 3 for antibody 59895
QQFNNYPYT

SEQ ID NO: 119790 - protein, 15 aa, Homo sapiens
  heavy chain complementarity determining region 3 for antibody 59895
AREGFGESFHWFFAL

SEQ ID NO: 119791 - protein, 9 aa, Homo sapiens
  light chain complementarity determining region 3 for antibody 59896
QQFNNYPYT

SEQ ID NO: 119792 - protein, 15 aa, Homo sapiens
  heavy chain complementarity determining region 3 for antibody 59896
AREGFGEAFHWFFDL

SEQ ID NO: 119793 - protein, 9 aa, Homo sapiens
  light chain complementarity determining region 3 for antibody 59897
QQFNNYPYT

SEQ ID NO: 119794 - protein, 15 aa, Homo sapiens
  heavy chain complementarity determining region 3 for antibody 59897
AREGFGDSFHWFFDL

SEQ ID NO: 119795 - protein, 9 aa, Homo sapiens
  light chain complementarity determining region 3 for antibody 59898
QQFNNYPHT

SEQ ID NO: 119796 - protein, 11 aa, Homo sapiens
  heavy chain complementarity determining region 3 for antibody 59898
ARDGYSYYLDY

SEQ ID NO: 119797 - protein, 9 aa, Homo sapiens
  light chain complementarity determining region 3 for antibody 59899
QQFNNYPHT

SEQ ID NO: 119798 - protein, 11 aa, Homo sapiens
  heavy chain complementarity determining region 3 for antibody 59899
ARDGYSYYFAS

SEQ ID NO: 119799 - protein, 9 aa, Homo sapiens
  light chain complementarity determining region 3 for antibody 59900
QQFNNYPHT

SEQ ID NO: 119800 - protein, 11 aa, Homo sapiens
  heavy chain complementarity determining region 3 for antibody 59900
ARDGYSSYIDY

SEQ ID NO: 119801 - protein, 9 aa, Homo sapiens
  light chain complementarity determining region 3 for antibody 59901
QQFNNYPHT

SEQ ID NO: 119802 - protein, 11 aa, Homo sapiens
  heavy chain complementarity determining region 3 for antibody 59901
ARDGYSCYFDY

SEQ ID NO: 119803 - protein, 9 aa, Homo sapiens
  light chain complementarity determining region 3 for antibody 59902
QQFNNYPHT

SEQ ID NO: 119804 - protein, 11 aa, Homo sapiens
  heavy chain complementarity determining region 3 for antibody 59902
ARDGYAYYFDY

SEQ ID NO: 119805 - protein, 9 aa, Homo sapiens
  light chain complementarity determining region 3 for antibody 59903
QQFNNYPHT

SEQ ID NO: 119806 - protein, 11 aa, Homo sapiens
  heavy chain complementarity determining region 3 for antibody 59903
ARDGSSYYIDY

SEQ ID NO: 119807 - protein, 9 aa, Homo sapiens
  light chain complementarity determining region 3 for antibody 59904
QQFNNYPHT

SEQ ID NO: 119808 - protein, 11 aa, Homo sapiens
  heavy chain complementarity determining region 3 for antibody 59904
ARDGSSYSFDY

SEQ ID NO: 119809 - protein, 9 aa, Homo sapiens
  light chain complementarity determining region 3 for antibody 59905
QQFNNYPHT

SEQ ID NO: 119810 - protein, 11 aa, Homo sapiens
  heavy chain complementarity determining region 3 for antibody 59905
ARDGFSYYIDY

SEQ ID NO: 119811 - protein, 9 aa, Homo sapiens
  light chain complementarity determining region 3 for antibody 59906
QQFNNYPHT

SEQ ID NO: 119812 - protein, 11 aa, Homo sapiens
  heavy chain complementarity determining region 3 for antibody 59906
ARDGCSYCFDY

SEQ ID NO: 119813 - protein, 9 aa, Homo sapiens
  light chain complementarity determining region 3 for antibody 59907
QQFNNYPHT

SEQ ID NO: 119814 - protein, 11 aa, Homo sapiens
  heavy chain complementarity determining region 3 for antibody 59907
ARDAYSYYFDS

SEQ ID NO: 119815 - protein, 9 aa, Homo sapiens
  light chain complementarity determining region 3 for antibody 59908
QQFNNYPHT

SEQ ID NO: 119816 - protein, 11 aa, Homo sapiens
  heavy chain complementarity determining region 3 for antibody 59908
ARDAYSSYFDY

SEQ ID NO: 119817 - protein, 9 aa, Homo sapiens
  light chain complementarity determining region 3 for antibody 59909
QQFNNYPHT

SEQ ID NO: 119818 - protein, 11 aa, Homo sapiens
  heavy chain complementarity determining region 3 for antibody 59909
AIDGYSYYFDY

SEQ ID NO: 119819 - protein, 9 aa, Homo sapiens
  light chain complementarity determining region 3 for antibody 59910
QQDDNLPYT

SEQ ID NO: 119820 - protein, 12 aa, Homo sapiens
  heavy chain complementarity determining region 3 for antibody 59910
ARAVAGYWYFDL

SEQ ID NO: 119821 - protein, 9 aa, Homo sapiens
  light chain complementarity determining region 3 for antibody 59911
QKYNSYPRT

SEQ ID NO: 119822 - protein, 17 aa, Homo sapiens
  heavy chain complementarity determining region 3 for antibody 59911
STAPVGTTLYYYYGMDV

SEQ ID NO: 119823 - protein, 9 aa, Homo sapiens
  light chain complementarity determining region 3 for antibody 59912
QKYNSAPLT

SEQ ID NO: 119824 - protein, 12 aa, Homo sapiens
  heavy chain complementarity determining region 3 for antibody 59912
ARLWFGQGPIDY

SEQ ID NO: 119825 - protein, 9 aa, Homo sapiens
  light chain complementarity determining region 3 for antibody 59913
QKYDNLPYT

SEQ ID NO: 119826 - protein, 9 aa, Homo sapiens
  heavy chain complementarity determining region 3 for antibody 59913
AKDGAVAQH

SEQ ID NO: 119827 - protein, 9 aa, Homo sapiens
  light chain complementarity determining region 3 for antibody 59914
QHYDNLPYT

SEQ ID NO: 119828 - protein, 12 aa, Homo sapiens
  heavy chain complementarity determining region 3 for antibody 59914
ARAVAGYWYFDL

SEQ ID NO: 119829 - protein, 9 aa, Homo sapiens
  light chain complementarity determining region 3 for antibody 59915
QHYDNLPYT

SEQ ID NO: 119830 - protein, 9 aa, Homo sapiens
  heavy chain complementarity determining region 3 for antibody 59915
AKDGAVAQH

SEQ ID NO: 119831 - protein, 10 aa, Homo sapiens
  light chain complementarity determining region 3 for antibody 59916
PQFNSYPPYT

SEQ ID NO: 119832 - protein, 14 aa, Homo sapiens
  heavy chain complementarity determining region 3 for antibody 59916
AGDGRLTMVRGGDF

SEQ ID NO: 119833 - protein, 9 aa, Homo sapiens
  light chain complementarity determining region 3 for antibody 59917
LRDYNYPRT

SEQ ID NO: 119834 - protein, 11 aa, Homo sapiens
  heavy chain complementarity determining region 3 for antibody 59917
TRDTLERGFDY

SEQ ID NO: 119835 - protein, 9 aa, Homo sapiens
  light chain complementarity determining region 3 for antibody 59918
LQYYNYPRT

SEQ ID NO: 119836 - protein, 11 aa, Homo sapiens
  heavy chain complementarity determining region 3 for antibody 59918
TRETLERGFDY

SEQ ID NO: 119837 - protein, 9 aa, Homo sapiens
  light chain complementarity determining region 3 for antibody 59919
LQSDNLPFT

SEQ ID NO: 119838 - protein, 11 aa, Homo sapiens
  heavy chain complementarity determining region 3 for antibody 59919
TRGGSSYATDY

SEQ ID NO: 119839 - protein, 9 aa, Homo sapiens
  light chain complementarity determining region 3 for antibody 59920
LQNYNYPRT

SEQ ID NO: 119840 - protein, 11 aa, Homo sapiens
  heavy chain complementarity determining region 3 for antibody 59920
TRETLERGFDY

SEQ ID NO: 119841 - protein, 9 aa, Homo sapiens
  light chain complementarity determining region 3 for antibody 59921
LQHTSYPPT

SEQ ID NO: 119842 - protein, 17 aa, Homo sapiens
  heavy chain complementarity determining region 3 for antibody 59921
AREGNDILTGYYHAFDI

SEQ ID NO: 119843 - protein, 9 aa, Homo sapiens
  light chain complementarity determining region 3 for antibody 59922
LQHNSYPYT

SEQ ID NO: 119844 - protein, 12 aa, Homo sapiens
  heavy chain complementarity determining region 3 for antibody 59922
ARDVFLFCGEFP

SEQ ID NO: 119845 - protein, 9 aa, Homo sapiens
  light chain complementarity determining region 3 for antibody 59923
LQHNSYPYT

SEQ ID NO: 119846 - protein, 12 aa, Homo sapiens
  heavy chain complementarity determining region 3 for antibody 59923
AKDRSYYYGMDV

SEQ ID NO: 119847 - protein, 9 aa, Homo sapiens
  light chain complementarity determining region 3 for antibody 59924
LQHNSYPYT

SEQ ID NO: 119848 - protein, 15 aa, Homo sapiens
  heavy chain complementarity determining region 3 for antibody 59924
AGERGLWFGREGMDV

SEQ ID NO: 119849 - protein, 9 aa, Homo sapiens
  light chain complementarity determining region 3 for antibody 59925
LQHNSYPYT

SEQ ID NO: 119850 - protein, 15 aa, Homo sapiens
  heavy chain complementarity determining region 3 for antibody 59925
AGERGLWFGLEGIDV

SEQ ID NO: 119851 - protein, 9 aa, Homo sapiens
  light chain complementarity determining region 3 for antibody 59926
LQHNSYPYT

SEQ ID NO: 119852 - protein, 15 aa, Homo sapiens
  heavy chain complementarity determining region 3 for antibody 59926
AGERGIWFGLEGMDV

SEQ ID NO: 119853 - protein, 9 aa, Homo sapiens
  light chain complementarity determining region 3 for antibody 59927
LQHNSYPWT

SEQ ID NO: 119854 - protein, 14 aa, Homo sapiens
  heavy chain complementarity determining region 3 for antibody 59927
ARRGRVGGTSHFDY

SEQ ID NO: 119855 - protein, 9 aa, Homo sapiens
  light chain complementarity determining region 3 for antibody 59928
LQHNSYPTT

SEQ ID NO: 119856 - protein, 17 aa, Homo sapiens
  heavy chain complementarity determining region 3 for antibody 59928
AREGNDILTGYYHAFDI

SEQ ID NO: 119857 - protein, 9 aa, Homo sapiens
  light chain complementarity determining region 3 for antibody 59929
LQHNSYPST

SEQ ID NO: 119858 - protein, 17 aa, Homo sapiens
  heavy chain complementarity determining region 3 for antibody 59929
AREGNDILTGYYHAFDI

SEQ ID NO: 119859 - protein, 9 aa, Homo sapiens
  light chain complementarity determining region 3 for antibody 59930
LQHNSYPPT

SEQ ID NO: 119860 - protein, 17 aa, Homo sapiens
  heavy chain complementarity determining region 3 for antibody 59930
SREGNDILTGYYHAFDI

SEQ ID NO: 119861 - protein, 9 aa, Homo sapiens
  light chain complementarity determining region 3 for antibody 59931
LQHNSYPPT

SEQ ID NO: 119862 - protein, 17 aa, Homo sapiens
  heavy chain complementarity determining region 3 for antibody 59931
AREVNDILTGYYHAFDI

SEQ ID NO: 119863 - protein, 9 aa, Homo sapiens
  light chain complementarity determining region 3 for antibody 59932
LQHNSYPPT

SEQ ID NO: 119864 - protein, 17 aa, Homo sapiens
  heavy chain complementarity determining region 3 for antibody 59932
AREGSDILTGYYHAFDI

SEQ ID NO: 119865 - protein, 9 aa, Homo sapiens
  light chain complementarity determining region 3 for antibody 59933
LQHNSYPPT

SEQ ID NO: 119866 - protein, 17 aa, Homo sapiens
  heavy chain complementarity determining region 3 for antibody 59933
AREGNGILAGYYHAFDI

SEQ ID NO: 119867 - protein, 9 aa, Homo sapiens
  light chain complementarity determining region 3 for antibody 59934
LQHNSYPPT

SEQ ID NO: 119868 - protein, 17 aa, Homo sapiens
  heavy chain complementarity determining region 3 for antibody 59934
AREGNDIVAGYYHAFDI

SEQ ID NO: 119869 - protein, 9 aa, Homo sapiens
  light chain complementarity determining region 3 for antibody 59935
LQHNSYPPT

SEQ ID NO: 119870 - protein, 17 aa, Homo sapiens
  heavy chain complementarity determining region 3 for antibody 59935
AREGNDIMTGYYHAFDI

SEQ ID NO: 119871 - protein, 9 aa, Homo sapiens
  light chain complementarity determining region 3 for antibody 59936
LQHNSYPPT

SEQ ID NO: 119872 - protein, 17 aa, Homo sapiens
  heavy chain complementarity determining region 3 for antibody 59936
AREGNDILTVYYHAFDI

SEQ ID NO: 119873 - protein, 9 aa, Homo sapiens
  light chain complementarity determining region 3 for antibody 59937
LQHNSYPPT

SEQ ID NO: 119874 - protein, 17 aa, Homo sapiens
  heavy chain complementarity determining region 3 for antibody 59937
AREGNDILTGYYYAFDL

SEQ ID NO: 119875 - protein, 9 aa, Homo sapiens
  light chain complementarity determining region 3 for antibody 59938
LQHNSYPPT

SEQ ID NO: 119876 - protein, 17 aa, Homo sapiens
  heavy chain complementarity determining region 3 for antibody 59938
AREGNDILTGYYHAVDI

SEQ ID NO: 119877 - protein, 9 aa, Homo sapiens
  light chain complementarity determining region 3 for antibody 59939
LQHNSYPPT

SEQ ID NO: 119878 - protein, 17 aa, Homo sapiens
  heavy chain complementarity determining region 3 for antibody 59939
AREGNDILTGYDHAFDI

SEQ ID NO: 119879 - protein, 9 aa, Homo sapiens
  light chain complementarity determining region 3 for antibody 59940
LQHNSYPPT

SEQ ID NO: 119880 - protein, 17 aa, Homo sapiens
  heavy chain complementarity determining region 3 for antibody 59940
AREGNDILTGYCHAFDI

SEQ ID NO: 119881 - protein, 9 aa, Homo sapiens
  light chain complementarity determining region 3 for antibody 59941
LQHNSYPPT

SEQ ID NO: 119882 - protein, 17 aa, Homo sapiens
  heavy chain complementarity determining region 3 for antibody 59941
AREGNDILTGSYHAFDI

SEQ ID NO: 119883 - protein, 9 aa, Homo sapiens
  light chain complementarity determining region 3 for antibody 59942
LQHNSYPPT

SEQ ID NO: 119884 - protein, 17 aa, Homo sapiens
  heavy chain complementarity determining region 3 for antibody 59942
AREGNDILTDYYHAFDI

SEQ ID NO: 119885 - protein, 9 aa, Homo sapiens
  light chain complementarity determining region 3 for antibody 59943
LQHNSYPPT

SEQ ID NO: 119886 - protein, 17 aa, Homo sapiens
  heavy chain complementarity determining region 3 for antibody 59943
AREGDGILTGYYHAFDI

SEQ ID NO: 119887 - protein, 9 aa, Homo sapiens
  light chain complementarity determining region 3 for antibody 59944
LQHNSYPPT

SEQ ID NO: 119888 - protein, 17 aa, Homo sapiens
  heavy chain complementarity determining region 3 for antibody 59944
AREGDDILTGYYHAFDV

SEQ ID NO: 119889 - protein, 9 aa, Homo sapiens
  light chain complementarity determining region 3 for antibody 59945
LQHNSYPPT

SEQ ID NO: 119890 - protein, 17 aa, Homo sapiens
  heavy chain complementarity determining region 3 for antibody 59945
AREGDDILTGYYHAFDF

SEQ ID NO: 119891 - protein, 9 aa, Homo sapiens
  light chain complementarity determining region 3 for antibody 59946
LQHNSYPPT

SEQ ID NO: 119892 - protein, 17 aa, Homo sapiens
  heavy chain complementarity determining region 3 for antibody 59946
AREGDDILSGYYHAFDI

SEQ ID NO: 119893 - protein, 9 aa, Homo sapiens
  light chain complementarity determining region 3 for antibody 59947
LQHNSYPPT

SEQ ID NO: 119894 - protein, 17 aa, Homo sapiens
  heavy chain complementarity determining region 3 for antibody 59947
ARDGNDILTGYYHAFDI

SEQ ID NO: 119895 - protein, 9 aa, Homo sapiens
  light chain complementarity determining region 3 for antibody 59948
LQHNSYPPT

SEQ ID NO: 119896 - protein, 17 aa, Homo sapiens
  heavy chain complementarity determining region 3 for antibody 59948
ARAGNDILTGYYHAFDI

SEQ ID NO: 119897 - protein, 9 aa, Homo sapiens
  light chain complementarity determining region 3 for antibody 59949
LQHNSYPPM

SEQ ID NO: 119898 - protein, 17 aa, Homo sapiens
  heavy chain complementarity determining region 3 for antibody 59949
AREGNDILTGYYHAFDI

SEQ ID NO: 119899 - protein, 9 aa, Homo sapiens
  light chain complementarity determining region 3 for antibody 59950
LQHNSYPLT

SEQ ID NO: 119900 - protein, 15 aa, Homo sapiens
  heavy chain complementarity determining region 3 for antibody 59950
ASGGFWEFYYYGMDV

SEQ ID NO: 119901 - protein, 9 aa, Homo sapiens
  light chain complementarity determining region 3 for antibody 59951
LQHNSYPLT

SEQ ID NO: 119902 - protein, 15 aa, Homo sapiens
  heavy chain complementarity determining region 3 for antibody 59951
ARGGFGEVYYYGMDV

SEQ ID NO: 119903 - protein, 9 aa, Homo sapiens
  light chain complementarity determining region 3 for antibody 59952
LQHNSYPLT

SEQ ID NO: 119904 - protein, 15 aa, Homo sapiens
  heavy chain complementarity determining region 3 for antibody 59952
ARGGFGESYSYGMDV

SEQ ID NO: 119905 - protein, 9 aa, Homo sapiens
  light chain complementarity determining region 3 for antibody 59953
LQHNSYPLT

SEQ ID NO: 119906 - protein, 15 aa, Homo sapiens
  heavy chain complementarity determining region 3 for antibody 59953
ARGGFGEFYYYGMAV

SEQ ID NO: 119907 - protein, 9 aa, Homo sapiens
  light chain complementarity determining region 3 for antibody 59954
LQHNSYPLT

SEQ ID NO: 119908 - protein, 15 aa, Homo sapiens
  heavy chain complementarity determining region 3 for antibody 59954
ARGGFGEFYYYGIDV

SEQ ID NO: 119909 - protein, 9 aa, Homo sapiens
  light chain complementarity determining region 3 for antibody 59955
LQHNSYPLT

SEQ ID NO: 119910 - protein, 15 aa, Homo sapiens
  heavy chain complementarity determining region 3 for antibody 59955
ARGGFGEFYPYGMDV

SEQ ID NO: 119911 - protein, 9 aa, Homo sapiens
  light chain complementarity determining region 3 for antibody 59956
LQHNSYPLT

SEQ ID NO: 119912 - protein, 15 aa, Homo sapiens
  heavy chain complementarity determining region 3 for antibody 59956
ARGGFGEFSYYGMDV

SEQ ID NO: 119913 - protein, 9 aa, Homo sapiens
  light chain complementarity determining region 3 for antibody 59957
LQHNSYPLT

SEQ ID NO: 119914 - protein, 15 aa, Homo sapiens
  heavy chain complementarity determining region 3 for antibody 59957
ARGGFGEFCYYGMDV

SEQ ID NO: 119915 - protein, 9 aa, Homo sapiens
  light chain complementarity determining region 3 for antibody 59958
LQHNSYPLT

SEQ ID NO: 119916 - protein, 15 aa, Homo sapiens
  heavy chain complementarity determining region 3 for antibody 59958
ARGGFGECYHYGMDV

SEQ ID NO: 119917 - protein, 9 aa, Homo sapiens
  light chain complementarity determining region 3 for antibody 59959
LQHNSYPLT

SEQ ID NO: 119918 - protein, 15 aa, Homo sapiens
  heavy chain complementarity determining region 3 for antibody 59959
ARGGFGDFYYYGMDV

SEQ ID NO: 119919 - protein, 9 aa, Homo sapiens
  light chain complementarity determining region 3 for antibody 59960
LQHNSYPFT

SEQ ID NO: 119920 - protein, 13 aa, Homo sapiens
  heavy chain complementarity determining region 3 for antibody 59960
ASDYGAYVGAFDI

SEQ ID NO: 119921 - protein, 9 aa, Homo sapiens
  light chain complementarity determining region 3 for antibody 59961
LQHNSYHPT

SEQ ID NO: 119922 - protein, 17 aa, Homo sapiens
  heavy chain complementarity determining region 3 for antibody 59961
AREGNDILTGYYHAFDI

SEQ ID NO: 119923 - protein, 9 aa, Homo sapiens
  light chain complementarity determining region 3 for antibody 59962
LQHNSHPPT

SEQ ID NO: 119924 - protein, 17 aa, Homo sapiens
  heavy chain complementarity determining region 3 for antibody 59962
AREGNDILTGYYHAFDI

SEQ ID NO: 119925 - protein, 9 aa, Homo sapiens
  light chain complementarity determining region 3 for antibody 59963
LQHNNYPYT

SEQ ID NO: 119926 - protein, 12 aa, Homo sapiens
  heavy chain complementarity determining region 3 for antibody 59963
DRDVFLFFGEFP

SEQ ID NO: 119927 - protein, 9 aa, Homo sapiens
  light chain complementarity determining region 3 for antibody 59964
LQHNNYPYT

SEQ ID NO: 119928 - protein, 12 aa, Homo sapiens
  heavy chain complementarity determining region 3 for antibody 59964
ARDVVLFFGESP

SEQ ID NO: 119929 - protein, 9 aa, Homo sapiens
  light chain complementarity determining region 3 for antibody 59965
LQHNNYPYT

SEQ ID NO: 119930 - protein, 12 aa, Homo sapiens
  heavy chain complementarity determining region 3 for antibody 59965
ARDVSLSFGEFP

SEQ ID NO: 119931 - protein, 9 aa, Homo sapiens
  light chain complementarity determining region 3 for antibody 59966
LQHNNYPYT

SEQ ID NO: 119932 - protein, 12 aa, Homo sapiens
  heavy chain complementarity determining region 3 for antibody 59966
ARDVSLFFGEFH

SEQ ID NO: 119933 - protein, 9 aa, Homo sapiens
  light chain complementarity determining region 3 for antibody 59967
LQHNNYPYT

SEQ ID NO: 119934 - protein, 12 aa, Homo sapiens
  heavy chain complementarity determining region 3 for antibody 59967
ARDVFLSFGESP

SEQ ID NO: 119935 - protein, 9 aa, Homo sapiens
  light chain complementarity determining region 3 for antibody 59968
LQHNNYPYT

SEQ ID NO: 119936 - protein, 12 aa, Homo sapiens
  heavy chain complementarity determining region 3 for antibody 59968
ARDVFLFYGEYP

SEQ ID NO: 119937 - protein, 9 aa, Homo sapiens
  light chain complementarity determining region 3 for antibody 59969
LQHNNYPYT

SEQ ID NO: 119938 - protein, 12 aa, Homo sapiens
  heavy chain complementarity determining region 3 for antibody 59969
ARDVFLFSGEFH

SEQ ID NO: 119939 - protein, 9 aa, Homo sapiens
  light chain complementarity determining region 3 for antibody 59970
LQHNNYPYT

SEQ ID NO: 119940 - protein, 12 aa, Homo sapiens
  heavy chain complementarity determining region 3 for antibody 59970
ARDVFLFSGEAP

SEQ ID NO: 119941 - protein, 9 aa, Homo sapiens
  light chain complementarity determining region 3 for antibody 59971
LQHNNYPYT

SEQ ID NO: 119942 - protein, 12 aa, Homo sapiens
  heavy chain complementarity determining region 3 for antibody 59971
ARDVFLFFGKVP

SEQ ID NO: 119943 - protein, 9 aa, Homo sapiens
  light chain complementarity determining region 3 for antibody 59972
LQHNNYPYT

SEQ ID NO: 119944 - protein, 12 aa, Homo sapiens
  heavy chain complementarity determining region 3 for antibody 59972
ARDVFLFFGEPP

SEQ ID NO: 119945 - protein, 9 aa, Homo sapiens
  light chain complementarity determining region 3 for antibody 59973
LQHNNYPYT

SEQ ID NO: 119946 - protein, 12 aa, Homo sapiens
  heavy chain complementarity determining region 3 for antibody 59973
ARDVFLFFGEFA

SEQ ID NO: 119947 - protein, 9 aa, Homo sapiens
  light chain complementarity determining region 3 for antibody 59974
LQHNNYPYT

SEQ ID NO: 119948 - protein, 12 aa, Homo sapiens
  heavy chain complementarity determining region 3 for antibody 59974
ARDVFLFCGEYP

SEQ ID NO: 119949 - protein, 9 aa, Homo sapiens
  light chain complementarity determining region 3 for antibody 59975
LQHNNYPYT

SEQ ID NO: 119950 - protein, 12 aa, Homo sapiens
  heavy chain complementarity determining region 3 for antibody 59975
ARDVCLFSGEFP

SEQ ID NO: 119951 - protein, 9 aa, Homo sapiens
  light chain complementarity determining region 3 for antibody 59976
LQHNNYPYT

SEQ ID NO: 119952 - protein, 12 aa, Homo sapiens
  heavy chain complementarity determining region 3 for antibody 59976
ARDVCLFCGESL

SEQ ID NO: 119953 - protein, 9 aa, Homo sapiens
  light chain complementarity determining region 3 for antibody 59977
LQHNNYPYT

SEQ ID NO: 119954 - protein, 12 aa, Homo sapiens
  heavy chain complementarity determining region 3 for antibody 59977
ARDGFLFFGEFP

SEQ ID NO: 119955 - protein, 9 aa, Homo sapiens
  light chain complementarity determining region 3 for antibody 59978
LQHNNYPHT

SEQ ID NO: 119956 - protein, 12 aa, Homo sapiens
  heavy chain complementarity determining region 3 for antibody 59978
ARDVFLFFGEFP

SEQ ID NO: 119957 - protein, 9 aa, Homo sapiens
  light chain complementarity determining region 3 for antibody 59979
LQDYSYPRT

SEQ ID NO: 119958 - protein, 11 aa, Homo sapiens
  heavy chain complementarity determining region 3 for antibody 59979
TRETLERGFDY

SEQ ID NO: 119959 - protein, 9 aa, Homo sapiens
  light chain complementarity determining region 3 for antibody 59980
LQDYNYTRT

SEQ ID NO: 119960 - protein, 11 aa, Homo sapiens
  heavy chain complementarity determining region 3 for antibody 59980
TRETLERGFDY

SEQ ID NO: 119961 - protein, 9 aa, Homo sapiens
  light chain complementarity determining region 3 for antibody 59981
LQDYNYSRT

SEQ ID NO: 119962 - protein, 11 aa, Homo sapiens
  heavy chain complementarity determining region 3 for antibody 59981
TRETLERGFDY

SEQ ID NO: 119963 - protein, 9 aa, Homo sapiens
  light chain complementarity determining region 3 for antibody 59982
LQDYNYPYT

SEQ ID NO: 119964 - protein, 17 aa, Homo sapiens
  heavy chain complementarity determining region 3 for antibody 59982
ARELRYFDGFLSDAFDI

SEQ ID NO: 119965 - protein, 9 aa, Homo sapiens
  light chain complementarity determining region 3 for antibody 59983
LQDYNYPYT

SEQ ID NO: 119966 - protein, 13 aa, Homo sapiens
  heavy chain complementarity determining region 3 for antibody 59983
ARDRYSDWLSLDY

SEQ ID NO: 119967 - protein, 9 aa, Homo sapiens
  light chain complementarity determining region 3 for antibody 59984
LQDYNYPYT

SEQ ID NO: 119968 - protein, 17 aa, Homo sapiens
  heavy chain complementarity determining region 3 for antibody 59984
ARDLRYFDGFVSDAFDI

SEQ ID NO: 119969 - protein, 9 aa, Homo sapiens
  light chain complementarity determining region 3 for antibody 59985
LQDYNYPWT

SEQ ID NO: 119970 - protein, 11 aa, Homo sapiens
  heavy chain complementarity determining region 3 for antibody 59985
TRETLERGFDY

SEQ ID NO: 119971 - protein, 9 aa, Homo sapiens
  light chain complementarity determining region 3 for antibody 59986
LQDYNYPWT

SEQ ID NO: 119972 - protein, 11 aa, Homo sapiens
  heavy chain complementarity determining region 3 for antibody 59986
AREGSLYGMDV

SEQ ID NO: 119973 - protein, 9 aa, Homo sapiens
  light chain complementarity determining region 3 for antibody 59987
LQDYNYPWT

SEQ ID NO: 119974 - protein, 21 aa, Homo sapiens
  heavy chain complementarity determining region 3 for antibody 59987
AREGRDYGSGSHYYYYYGMDV

SEQ ID NO: 119975 - protein, 9 aa, Homo sapiens
  light chain complementarity determining region 3 for antibody 59988
LQDYNYPWT

SEQ ID NO: 119976 - protein, 11 aa, Homo sapiens
  heavy chain complementarity determining region 3 for antibody 59988
AREGALYGMDA

SEQ ID NO: 119977 - protein, 9 aa, Homo sapiens
  light chain complementarity determining region 3 for antibody 59989
LQDYNYPWT

SEQ ID NO: 119978 - protein, 11 aa, Homo sapiens
  heavy chain complementarity determining region 3 for antibody 59989
AREGALYGIDD

SEQ ID NO: 119979 - protein, 9 aa, Homo sapiens
  light chain complementarity determining region 3 for antibody 59990
LQDYNYPWT

SEQ ID NO: 119980 - protein, 11 aa, Homo sapiens
  heavy chain complementarity determining region 3 for antibody 59990
AREGAFYGMDV

SEQ ID NO: 119981 - protein, 9 aa, Homo sapiens
  light chain complementarity determining region 3 for antibody 59991
LQDYNYPWT

SEQ ID NO: 119982 - protein, 15 aa, Homo sapiens
  heavy chain complementarity determining region 3 for antibody 59991
AREFGSYSIGWYFDY

SEQ ID NO: 119983 - protein, 9 aa, Homo sapiens
  light chain complementarity determining region 3 for antibody 59992
LQDYNYPWT

SEQ ID NO: 119984 - protein, 11 aa, Homo sapiens
  heavy chain complementarity determining region 3 for antibody 59992
ARECALYGMDV

SEQ ID NO: 119985 - protein, 9 aa, Homo sapiens
  light chain complementarity determining region 3 for antibody 59993
LQDYNYPWT

SEQ ID NO: 119986 - protein, 21 aa, Homo sapiens
  heavy chain complementarity determining region 3 for antibody 59993
ARDGRDYGSGSHYYYYYAMDV

SEQ ID NO: 119987 - protein, 9 aa, Homo sapiens
  light chain complementarity determining region 3 for antibody 59994
LQDYNYPWT

SEQ ID NO: 119988 - protein, 21 aa, Homo sapiens
  heavy chain complementarity determining region 3 for antibody 59994
ARDGRDYGSGSHYYYYSGMDV

SEQ ID NO: 119989 - protein, 9 aa, Homo sapiens
  light chain complementarity determining region 3 for antibody 59995
LQDYNYPWT

SEQ ID NO: 119990 - protein, 21 aa, Homo sapiens
  heavy chain complementarity determining region 3 for antibody 59995
ARDGRDYGSGSHYYYSYGMDV

SEQ ID NO: 119991 - protein, 9 aa, Homo sapiens
  light chain complementarity determining region 3 for antibody 59996
LQDYNYPWT

SEQ ID NO: 119992 - protein, 21 aa, Homo sapiens
  heavy chain complementarity determining region 3 for antibody 59996
ARDGRDYGSGSHFYYYYGMDV

SEQ ID NO: 119993 - protein, 9 aa, Homo sapiens
  light chain complementarity determining region 3 for antibody 59997
LQDYNYPWT

SEQ ID NO: 119994 - protein, 21 aa, Homo sapiens
  heavy chain complementarity determining region 3 for antibody 59997
ARDGGDYGSGSHYSYSYGMDV

SEQ ID NO: 119995 - protein, 9 aa, Homo sapiens
  light chain complementarity determining region 3 for antibody 59998
LQDYNYPWT

SEQ ID NO: 119996 - protein, 21 aa, Homo sapiens
  heavy chain complementarity determining region 3 for antibody 59998
ARDGGDYGAGSHYYYYYGMDV

SEQ ID NO: 119997 - protein, 9 aa, Homo sapiens
  light chain complementarity determining region 3 for antibody 59999
LQDYNYPWT

SEQ ID NO: 119998 - protein, 11 aa, Homo sapiens
  heavy chain complementarity determining region 3 for antibody 59999
AGEGALYGMDV

SEQ ID NO: 119999 - protein, 9 aa, Homo sapiens
  light chain complementarity determining region 3 for antibody 60000
LQDYNYPRT

SEQ ID NO: 120000 - protein, 11 aa, Homo sapiens
  heavy chain complementarity determining region 3 for antibody 60000
TSETLERAFDY

SEQ ID NO: 120001 - protein, 9 aa, Homo sapiens
  light chain complementarity determining region 3 for antibody 60001
LQDYNYPRT

SEQ ID NO: 120002 - protein, 11 aa, Homo sapiens
  heavy chain complementarity determining region 3 for antibody 60001
TRVTLERGFDY

SEQ ID NO: 120003 - protein, 9 aa, Homo sapiens
  light chain complementarity determining region 3 for antibody 60002
LQDYNYPRT

SEQ ID NO: 120004 - protein, 11 aa, Homo sapiens
  heavy chain complementarity determining region 3 for antibody 60002
TRVTLARGFDY

SEQ ID NO: 120005 - protein, 9 aa, Homo sapiens
  light chain complementarity determining region 3 for antibody 60003
LQDYNYPRT

SEQ ID NO: 120006 - protein, 11 aa, Homo sapiens
  heavy chain complementarity determining region 3 for antibody 60003
TRGPLDRGFDY

SEQ ID NO: 120007 - protein, 9 aa, Homo sapiens
  light chain complementarity determining region 3 for antibody 60004
LQDYNYPRT

SEQ ID NO: 120008 - protein, 11 aa, Homo sapiens
  heavy chain complementarity determining region 3 for antibody 60004
TRETVERGVDY

SEQ ID NO: 120009 - protein, 9 aa, Homo sapiens
  light chain complementarity determining region 3 for antibody 60005
LQDYNYPRT

SEQ ID NO: 120010 - protein, 11 aa, Homo sapiens
  heavy chain complementarity determining region 3 for antibody 60005
TRETVERAFDY

SEQ ID NO: 120011 - protein, 9 aa, Homo sapiens
  light chain complementarity determining region 3 for antibody 60006
LQDYNYPRT

SEQ ID NO: 120012 - protein, 11 aa, Homo sapiens
  heavy chain complementarity determining region 3 for antibody 60006
TRETVDRGIDY

SEQ ID NO: 120013 - protein, 9 aa, Homo sapiens
  light chain complementarity determining region 3 for antibody 60007
LQDYNYPRT

SEQ ID NO: 120014 - protein, 11 aa, Homo sapiens
  heavy chain complementarity determining region 3 for antibody 60007
TRETRDRGFDY

SEQ ID NO: 120015 - protein, 9 aa, Homo sapiens
  light chain complementarity determining region 3 for antibody 60008
LQDYNYPRT

SEQ ID NO: 120016 - protein, 11 aa, Homo sapiens
  heavy chain complementarity determining region 3 for antibody 60008
TRETQERGFDY

SEQ ID NO: 120017 - protein, 9 aa, Homo sapiens
  light chain complementarity determining region 3 for antibody 60009
LQDYNYPRT

SEQ ID NO: 120018 - protein, 11 aa, Homo sapiens
  heavy chain complementarity determining region 3 for antibody 60009
TRETLSRGFAY

SEQ ID NO: 120019 - protein, 9 aa, Homo sapiens
  light chain complementarity determining region 3 for antibody 60010
LQDYNYPRT

SEQ ID NO: 120020 - protein, 11 aa, Homo sapiens
  heavy chain complementarity determining region 3 for antibody 60010
TRETLQRGLDY

SEQ ID NO: 120021 - protein, 9 aa, Homo sapiens
  light chain complementarity determining region 3 for antibody 60011
LQDYNYPRT

SEQ ID NO: 120022 - protein, 11 aa, Homo sapiens
  heavy chain complementarity determining region 3 for antibody 60011
TRETLERGFYY

SEQ ID NO: 120023 - protein, 9 aa, Homo sapiens
  light chain complementarity determining region 3 for antibody 60012
LQDYNYPRT

SEQ ID NO: 120024 - protein, 11 aa, Homo sapiens
  heavy chain complementarity determining region 3 for antibody 60012
TRETLERGFDH

SEQ ID NO: 120025 - protein, 9 aa, Homo sapiens
  light chain complementarity determining region 3 for antibody 60013
LQDYNYPRT

SEQ ID NO: 120026 - protein, 11 aa, Homo sapiens
  heavy chain complementarity determining region 3 for antibody 60013
TRETLEQAFDY

SEQ ID NO: 120027 - protein, 9 aa, Homo sapiens
  light chain complementarity determining region 3 for antibody 60014
LQDYNYPRT

SEQ ID NO: 120028 - protein, 11 aa, Homo sapiens
  heavy chain complementarity determining region 3 for antibody 60014
TRETLEPGFDS

SEQ ID NO: 120029 - protein, 9 aa, Homo sapiens
  light chain complementarity determining region 3 for antibody 60015
LQDYNYPRT

SEQ ID NO: 120030 - protein, 11 aa, Homo sapiens
  heavy chain complementarity determining region 3 for antibody 60015
TRETLDRGYDY

SEQ ID NO: 120031 - protein, 9 aa, Homo sapiens
  light chain complementarity determining region 3 for antibody 60016
LQDYNYPRT

SEQ ID NO: 120032 - protein, 11 aa, Homo sapiens
  heavy chain complementarity determining region 3 for antibody 60016
TRETLDRGVDY

SEQ ID NO: 120033 - protein, 9 aa, Homo sapiens
  light chain complementarity determining region 3 for antibody 60017
LQDYNYPRT

SEQ ID NO: 120034 - protein, 11 aa, Homo sapiens
  heavy chain complementarity determining region 3 for antibody 60017
TRETLDRGFHY

SEQ ID NO: 120035 - protein, 9 aa, Homo sapiens
  light chain complementarity determining region 3 for antibody 60018
LQDYNYPRT

SEQ ID NO: 120036 - protein, 11 aa, Homo sapiens
  heavy chain complementarity determining region 3 for antibody 60018
TRETLDRAIDY

SEQ ID NO: 120037 - protein, 9 aa, Homo sapiens
  light chain complementarity determining region 3 for antibody 60019
LQDYNYPRT

SEQ ID NO: 120038 - protein, 11 aa, Homo sapiens
  heavy chain complementarity determining region 3 for antibody 60019
TRETLDLGFDY

SEQ ID NO: 120039 - protein, 9 aa, Homo sapiens
  light chain complementarity determining region 3 for antibody 60020
LQDYNYPRT

SEQ ID NO: 120040 - protein, 11 aa, Homo sapiens
  heavy chain complementarity determining region 3 for antibody 60020
TRESLDRGFDY

SEQ ID NO: 120041 - protein, 9 aa, Homo sapiens
  light chain complementarity determining region 3 for antibody 60021
LQDYNYPRT

SEQ ID NO: 120042 - protein, 11 aa, Homo sapiens
  heavy chain complementarity determining region 3 for antibody 60021
TREPLERGLDY

SEQ ID NO: 120043 - protein, 9 aa, Homo sapiens
  light chain complementarity determining region 3 for antibody 60022
LQDYNYPRT

SEQ ID NO: 120044 - protein, 11 aa, Homo sapiens
  heavy chain complementarity determining region 3 for antibody 60022
TREPLERGFAY

SEQ ID NO: 120045 - protein, 9 aa, Homo sapiens
  light chain complementarity determining region 3 for antibody 60023
LQDYNYPRT

SEQ ID NO: 120046 - protein, 11 aa, Homo sapiens
  heavy chain complementarity determining region 3 for antibody 60023
TREKLERGIDY

SEQ ID NO: 120047 - protein, 9 aa, Homo sapiens
  light chain complementarity determining region 3 for antibody 60024
LQDYNYPRT

SEQ ID NO: 120048 - protein, 11 aa, Homo sapiens
  heavy chain complementarity determining region 3 for antibody 60024
TREALARGFDY

SEQ ID NO: 120049 - protein, 9 aa, Homo sapiens
  light chain complementarity determining region 3 for antibody 60025
LQDYNYPRT

SEQ ID NO: 120050 - protein, 11 aa, Homo sapiens
  heavy chain complementarity determining region 3 for antibody 60025
TRDTRERGFDY

SEQ ID NO: 120051 - protein, 9 aa, Homo sapiens
  light chain complementarity determining region 3 for antibody 60026
LQDYNYPRT

SEQ ID NO: 120052 - protein, 11 aa, Homo sapiens
  heavy chain complementarity determining region 3 for antibody 60026
TRDTLSRGFDY

SEQ ID NO: 120053 - protein, 9 aa, Homo sapiens
  light chain complementarity determining region 3 for antibody 60027
LQDYNYPRT

SEQ ID NO: 120054 - protein, 11 aa, Homo sapiens
  heavy chain complementarity determining region 3 for antibody 60027
TRDTLERGLDY

SEQ ID NO: 120055 - protein, 9 aa, Homo sapiens
  light chain complementarity determining region 3 for antibody 60028
LQDYNYPRT

SEQ ID NO: 120056 - protein, 11 aa, Homo sapiens
  heavy chain complementarity determining region 3 for antibody 60028
TRDTLEREFDY

SEQ ID NO: 120057 - protein, 9 aa, Homo sapiens
  light chain complementarity determining region 3 for antibody 60029
LQDYNYPRT

SEQ ID NO: 120058 - protein, 11 aa, Homo sapiens
  heavy chain complementarity determining region 3 for antibody 60029
TRDTLERAIDY

SEQ ID NO: 120059 - protein, 9 aa, Homo sapiens
  light chain complementarity determining region 3 for antibody 60030
LQDYNYPRT

SEQ ID NO: 120060 - protein, 11 aa, Homo sapiens
  heavy chain complementarity determining region 3 for antibody 60030
TRDTLDRGSDY

SEQ ID NO: 120061 - protein, 9 aa, Homo sapiens
  light chain complementarity determining region 3 for antibody 60031
LQDYNYPRT

SEQ ID NO: 120062 - protein, 11 aa, Homo sapiens
  heavy chain complementarity determining region 3 for antibody 60031
TRDTLARGFDS

SEQ ID NO: 120063 - protein, 9 aa, Homo sapiens
  light chain complementarity determining region 3 for antibody 60032
LQDYNYPRT

SEQ ID NO: 120064 - protein, 11 aa, Homo sapiens
  heavy chain complementarity determining region 3 for antibody 60032
TRDTLARGFAY

SEQ ID NO: 120065 - protein, 9 aa, Homo sapiens
  light chain complementarity determining region 3 for antibody 60033
LQDYNYPRT

SEQ ID NO: 120066 - protein, 11 aa, Homo sapiens
  heavy chain complementarity determining region 3 for antibody 60033
TRDTLAPGFDY

SEQ ID NO: 120067 - protein, 9 aa, Homo sapiens
  light chain complementarity determining region 3 for antibody 60034
LQDYNYPRT

SEQ ID NO: 120068 - protein, 11 aa, Homo sapiens
  heavy chain complementarity determining region 3 for antibody 60034
TIETLYRAFDY

SEQ ID NO: 120069 - protein, 9 aa, Homo sapiens
  light chain complementarity determining region 3 for antibody 60035
LQDYNYPRT

SEQ ID NO: 120070 - protein, 11 aa, Homo sapiens
  heavy chain complementarity determining region 3 for antibody 60035
TIETLERAFDY

SEQ ID NO: 120071 - protein, 9 aa, Homo sapiens
  light chain complementarity determining region 3 for antibody 60036
LQDYNYPRT

SEQ ID NO: 120072 - protein, 11 aa, Homo sapiens
  heavy chain complementarity determining region 3 for antibody 60036
TIETLARGFDY

SEQ ID NO: 120073 - protein, 9 aa, Homo sapiens
  light chain complementarity determining region 3 for antibody 60037
LQDYNYPRT

SEQ ID NO: 120074 - protein, 11 aa, Homo sapiens
  heavy chain complementarity determining region 3 for antibody 60037
TGETLDRGFDY

SEQ ID NO: 120075 - protein, 9 aa, Homo sapiens
  light chain complementarity determining region 3 for antibody 60038
LQDYNYPRT

SEQ ID NO: 120076 - protein, 11 aa, Homo sapiens
  heavy chain complementarity determining region 3 for antibody 60038
PRETLARGFDY

SEQ ID NO: 120077 - protein, 9 aa, Homo sapiens
  light chain complementarity determining region 3 for antibody 60039
LQDYNYPRT

SEQ ID NO: 120078 - protein, 11 aa, Homo sapiens
  heavy chain complementarity determining region 3 for antibody 60039
MRETLERGFDY

SEQ ID NO: 120079 - protein, 9 aa, Homo sapiens
  light chain complementarity determining region 3 for antibody 60040
LQDYNYPRT

SEQ ID NO: 120080 - protein, 11 aa, Homo sapiens
  heavy chain complementarity determining region 3 for antibody 60040
ARETLERAFDY

SEQ ID NO: 120081 - protein, 9 aa, Homo sapiens
  light chain complementarity determining region 3 for antibody 60041
LQDYNYPRP

SEQ ID NO: 120082 - protein, 11 aa, Homo sapiens
  heavy chain complementarity determining region 3 for antibody 60041
TRETLERGFDY

SEQ ID NO: 120083 - protein, 9 aa, Homo sapiens
  light chain complementarity determining region 3 for antibody 60042
LQDYNYPRM

SEQ ID NO: 120084 - protein, 11 aa, Homo sapiens
  heavy chain complementarity determining region 3 for antibody 60042
TRETLDRGFDY

SEQ ID NO: 120085 - protein, 9 aa, Homo sapiens
  light chain complementarity determining region 3 for antibody 60043
LQDYNYPRA

SEQ ID NO: 120086 - protein, 11 aa, Homo sapiens
  heavy chain complementarity determining region 3 for antibody 60043
TRETLARGFDY

SEQ ID NO: 120087 - protein, 9 aa, Homo sapiens
  light chain complementarity determining region 3 for antibody 60044
LQDYNSPRT

SEQ ID NO: 120088 - protein, 11 aa, Homo sapiens
  heavy chain complementarity determining region 3 for antibody 60044
TRETLERGFDY

SEQ ID NO: 120089 - protein, 9 aa, Homo sapiens
  light chain complementarity determining region 3 for antibody 60045
LQDYNHPRT

SEQ ID NO: 120090 - protein, 11 aa, Homo sapiens
  heavy chain complementarity determining region 3 for antibody 60045
TRDTLERGFDY

SEQ ID NO: 120091 - protein, 9 aa, Homo sapiens
  light chain complementarity determining region 3 for antibody 60046
LQDYIYPWT

SEQ ID NO: 120092 - protein, 11 aa, Homo sapiens
  heavy chain complementarity determining region 3 for antibody 60046
AREGAVAGLDY

SEQ ID NO: 120093 - protein, 9 aa, Homo sapiens
  light chain complementarity determining region 3 for antibody 60047
LQDYIYPWT

SEQ ID NO: 120094 - protein, 11 aa, Homo sapiens
  heavy chain complementarity determining region 3 for antibody 60047
ARDWAVAGLDY

SEQ ID NO: 120095 - protein, 9 aa, Homo sapiens
  light chain complementarity determining region 3 for antibody 60048
LQDYIYPWT

SEQ ID NO: 120096 - protein, 11 aa, Homo sapiens
  heavy chain complementarity determining region 3 for antibody 60048
ARDGVVAGLDY

SEQ ID NO: 120097 - protein, 9 aa, Homo sapiens
  light chain complementarity determining region 3 for antibody 60049
LQDYIYPWT

SEQ ID NO: 120098 - protein, 11 aa, Homo sapiens
  heavy chain complementarity determining region 3 for antibody 60049
ARDGAVARLDY

SEQ ID NO: 120099 - protein, 9 aa, Homo sapiens
  light chain complementarity determining region 3 for antibody 60050
LQDYIYPWT

SEQ ID NO: 120100 - protein, 11 aa, Homo sapiens
  heavy chain complementarity determining region 3 for antibody 60050
ARDGAVAGFDY

SEQ ID NO: 120101 - protein, 9 aa, Homo sapiens
  light chain complementarity determining region 3 for antibody 60051
LQDYIYPWT

SEQ ID NO: 120102 - protein, 11 aa, Homo sapiens
  heavy chain complementarity determining region 3 for antibody 60051
ARDGAGAGLDY

SEQ ID NO: 120103 - protein, 9 aa, Homo sapiens
  light chain complementarity determining region 3 for antibody 60052
LQDYIYPWT

SEQ ID NO: 120104 - protein, 11 aa, Homo sapiens
  heavy chain complementarity determining region 3 for antibody 60052
ARDEAVAGLDY

SEQ ID NO: 120105 - protein, 9 aa, Homo sapiens
  light chain complementarity determining region 3 for antibody 60053
LQDYIYPWT

SEQ ID NO: 120106 - protein, 11 aa, Homo sapiens
  heavy chain complementarity determining region 3 for antibody 60053
AIDGAVAGLDY

SEQ ID NO: 120107 - protein, 9 aa, Homo sapiens
  light chain complementarity determining region 3 for antibody 60054
LQDYIYPWM

SEQ ID NO: 120108 - protein, 11 aa, Homo sapiens
  heavy chain complementarity determining region 3 for antibody 60054
ARDGAVAGLDY

SEQ ID NO: 120109 - protein, 9 aa, Homo sapiens
  light chain complementarity determining region 3 for antibody 60055
LQDYIYPRT

SEQ ID NO: 120110 - protein, 11 aa, Homo sapiens
  heavy chain complementarity determining region 3 for antibody 60055
TRETLERGFDY

SEQ ID NO: 120111 - protein, 9 aa, Homo sapiens
  light chain complementarity determining region 3 for antibody 60056
LQDYDYPRT

SEQ ID NO: 120112 - protein, 11 aa, Homo sapiens
  heavy chain complementarity determining region 3 for antibody 60056
TRETLERGIDY

SEQ ID NO: 120113 - protein, 9 aa, Homo sapiens
  light chain complementarity determining region 3 for antibody 60057
LQDYDYPRT

SEQ ID NO: 120114 - protein, 11 aa, Homo sapiens
  heavy chain complementarity determining region 3 for antibody 60057
TRETLDRGFDY

SEQ ID NO: 120115 - protein, 9 aa, Homo sapiens
  light chain complementarity determining region 3 for antibody 60058
LQDYDYPFT

SEQ ID NO: 120116 - protein, 14 aa, Homo sapiens
  heavy chain complementarity determining region 3 for antibody 60058
AREGLWSGENWFDP

SEQ ID NO: 120117 - protein, 9 aa, Homo sapiens
  light chain complementarity determining region 3 for antibody 60059
LQDHNYPRT

SEQ ID NO: 120118 - protein, 11 aa, Homo sapiens
  heavy chain complementarity determining region 3 for antibody 60059
TRETLERGFDY

SEQ ID NO: 120119 - protein, 9 aa, Homo sapiens
  light chain complementarity determining region 3 for antibody 60060
KQYNSYPPT

SEQ ID NO: 120120 - protein, 12 aa, Homo sapiens
  heavy chain complementarity determining region 3 for antibody 60060
ARELEQQLVFDY

SEQ ID NO: 120121 - protein, 9 aa, Homo sapiens
  light chain complementarity determining region 3 for antibody 60061
KQLNSYPYT

SEQ ID NO: 120122 - protein, 19 aa, Homo sapiens
  heavy chain complementarity determining region 3 for antibody 60061
ARKGHYDILTGYFPDAFDI

SEQ ID NO: 120123 - protein, 9 aa, Homo sapiens
  light chain complementarity determining region 3 for antibody 60062
IQDYNYPRT

SEQ ID NO: 120124 - protein, 11 aa, Homo sapiens
  heavy chain complementarity determining region 3 for antibody 60062
TRETLDRGFDY

SEQ ID NO: 120125 - protein, 9 aa, Homo sapiens
  light chain complementarity determining region 3 for antibody 60063
HQYDNLPYT

SEQ ID NO: 120126 - protein, 12 aa, Homo sapiens
  heavy chain complementarity determining region 3 for antibody 60063
ARAVAGYWYFDL

SEQ ID NO: 120127 - protein, 9 aa, Homo sapiens
  light chain complementarity determining region 3 for antibody 60064
HQTSSLPLT

SEQ ID NO: 120128 - protein, 9 aa, Homo sapiens
  heavy chain complementarity determining region 3 for antibody 60064
ATDISATDY

SEQ ID NO: 120129 - protein, 9 aa, Homo sapiens
  light chain complementarity determining region 3 for antibody 60065
HQTSSLPLT

SEQ ID NO: 120130 - protein, 9 aa, Homo sapiens
  heavy chain complementarity determining region 3 for antibody 60065
ASDTSATDY

SEQ ID NO: 120131 - protein, 9 aa, Homo sapiens
  light chain complementarity determining region 3 for antibody 60066
HQTSSLPLT

SEQ ID NO: 120132 - protein, 9 aa, Homo sapiens
  heavy chain complementarity determining region 3 for antibody 60066
ASDISAAAY

SEQ ID NO: 120133 - protein, 9 aa, Homo sapiens
  light chain complementarity determining region 3 for antibody 60067
HQTSSLPLT

SEQ ID NO: 120134 - protein, 9 aa, Homo sapiens
  heavy chain complementarity determining region 3 for antibody 60067
ARDSSATDY

SEQ ID NO: 120135 - protein, 9 aa, Homo sapiens
  light chain complementarity determining region 3 for antibody 60068
HQTSSLPLT

SEQ ID NO: 120136 - protein, 9 aa, Homo sapiens
  heavy chain complementarity determining region 3 for antibody 60068
ARDLSAADY

SEQ ID NO: 120137 - protein, 9 aa, Homo sapiens
  light chain complementarity determining region 3 for antibody 60069
HQTSSLPLT

SEQ ID NO: 120138 - protein, 9 aa, Homo sapiens
  heavy chain complementarity determining region 3 for antibody 60069
ARDISAFDY

SEQ ID NO: 120139 - protein, 9 aa, Homo sapiens
  light chain complementarity determining region 3 for antibody 60070
HQTSSLPLT

SEQ ID NO: 120140 - protein, 9 aa, Homo sapiens
  heavy chain complementarity determining region 3 for antibody 60070
ARDISADAY

SEQ ID NO: 120141 - protein, 9 aa, Homo sapiens
  light chain complementarity determining region 3 for antibody 60071
HQTSSLPLT

SEQ ID NO: 120142 - protein, 9 aa, Homo sapiens
  heavy chain complementarity determining region 3 for antibody 60071
ARDISAAAY

SEQ ID NO: 120143 - protein, 9 aa, Homo sapiens
  light chain complementarity determining region 3 for antibody 60072
HQTSGLPLT

SEQ ID NO: 120144 - protein, 9 aa, Homo sapiens
  heavy chain complementarity determining region 3 for antibody 60072
ASDISADDY

SEQ ID NO: 120145 - protein, 9 aa, Homo sapiens
  light chain complementarity determining region 3 for antibody 60073
HQTSGLPLT

SEQ ID NO: 120146 - protein, 9 aa, Homo sapiens
  heavy chain complementarity determining region 3 for antibody 60073
ARDISATDY

SEQ ID NO: 120147 - protein, 9 aa, Homo sapiens
  light chain complementarity determining region 3 for antibody 60074
HQSSSLPYT

SEQ ID NO: 120148 - protein, 13 aa, Homo sapiens
  heavy chain complementarity determining region 3 for antibody 60074
ATHYDILTGYFDY

SEQ ID NO: 120149 - protein, 9 aa, Homo sapiens
  light chain complementarity determining region 3 for antibody 60075
HQSSSLPWT

SEQ ID NO: 120150 - protein, 16 aa, Homo sapiens
  heavy chain complementarity determining region 3 for antibody 60075
ASDRYSYGSGSYPFDK

SEQ ID NO: 120151 - protein, 9 aa, Homo sapiens
  light chain complementarity determining region 3 for antibody 60076
HQSSSLPWT

SEQ ID NO: 120152 - protein, 16 aa, Homo sapiens
  heavy chain complementarity determining region 3 for antibody 60076
APDRYYYGSGSYPFDK

SEQ ID NO: 120153 - protein, 9 aa, Homo sapiens
  light chain complementarity determining region 3 for antibody 60077
HQSSSLPWT

SEQ ID NO: 120154 - protein, 16 aa, Homo sapiens
  heavy chain complementarity determining region 3 for antibody 60077
AADRYYYGSGSYPFDN

SEQ ID NO: 120155 - protein, 9 aa, Homo sapiens
  light chain complementarity determining region 3 for antibody 60078
HQSSSLPHT

SEQ ID NO: 120156 - protein, 13 aa, Homo sapiens
  heavy chain complementarity determining region 3 for antibody 60078
ARGVYTSGWYFDY

SEQ ID NO: 120157 - protein, 9 aa, Homo sapiens
  light chain complementarity determining region 3 for antibody 60079
HQSSSLPHT

SEQ ID NO: 120158 - protein, 13 aa, Homo sapiens
  heavy chain complementarity determining region 3 for antibody 60079
ALNYGDYGDWFDP
